United States Patent 12,747,451 (RNA ENCODING AN ANTIBODY) - sequence listing, part 4

SEQ ID NO: 16848 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtcctc

SEQ ID NO: 16849 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcaccacctccaacatcggcaaccactacgtctcctggtaccagcagttccccggcaccgcccccaagctcatcatctacgagaccgaccgccgcccctccggcatccccgcccgcttctccggctccaagtccggcacctccgccaccctcgccatcgccggcctccagaccggcgacgaggccgactactactgcggcacctgggactcctccctctccaccggcggcgtcttcggcaccggcaccaaggtcaccgtcctc

SEQ ID NO: 16850 - RNA, 333 nt, synthetic construct
  misc_feature 1..333: note = derived and/or modified sequence opt2 from anti-HIV-1_LightChain
  source 1..333: mol_type = other RNA
cagctcgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtcctc

SEQ ID NO: 16851 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccatctcctgctccggcggctcctccaacatcggcaacaaccacgtctcctggtaccagcacctccccggccgcgccccccagctcctcatctacgacaccacccagcgcccctcccgcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16852 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaagatcaccatctcctgctccggctcccgctccaacatcggcaacaactacgtctcctggtaccagcagttccccggcaccgcccccaagctcctcatctacgacaacaaccagcgcccctcccgcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16853 - RNA, 321 nt, synthetic construct
  misc_feature 1..321: note = derived and/or modified sequence opt2 from anti-HIV-1_LightChain
  source 1..321: mol_type = other RNA
cagtccgtcctcacccagcccccctccgtctccgccgcccccggccagcgcgtcaccatctcctgcttcggctcccgcttctcctccgtctcctggtaccagcagctccccggcaccgcccccaagctcctcatctaccccaacggcgagcgcccctccggcatccccgaccgcttcttcggctccgagtccggcacctccgccaccctcggcatcaccggcctccagaccggcgacgaggccgactactactgcgccacctgggactcctccctctccgccggcggcgtcttcggcaccggcaccaagctcaccgtcctc

SEQ ID NO: 16854 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccctctccgccgcccccggccagaaggtcaccatctcctgctccggctcctccctcaacatcggcaaccactacgtctcctggtaccagcaggtccccggcaccgcccccaagctcctcatctacgaggacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16855 - RNA, 333 nt, synthetic construct
  misc_feature 1..333: note = derived and/or modified sequence opt2 from anti-HIV-1_LightChain
  source 1..333: mol_type = other RNA
cagttcgtcctcacccagcccccctccgtctccgccgcccccggccagaaggtcaccgtctcctgctccggcaccacctccgacatcggcgagaactacgtctcctggtaccagaagttccccgaggccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16856 - RNA, 333 nt, synthetic construct
  misc_feature 1..333: note = derived and/or modified sequence opt2 from anti-HIV-1_LightChain
  source 1..333: mol_type = other RNA
ctctccgtcctcacccagcccccctccgtctccgccgcccccggccagcaggtcaccatctcctgctccggcaccacctccaacatcggcaccaactacgtctcctggtaccagcagatgccccccaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16857 - RNA, 336 nt, synthetic construct
  misc_feature 1..336: note = derived and/or modified sequence opt2 from anti-HIV-1_LightChain
  source 1..336: mol_type = other RNA
cagtccatgctcacccagcccccctccgtctccggcgcccccggccagcgcgtcaccatctcctgcaccggctcccgctccaacatcggcgccggctacgacgtccactggtacctccagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16858 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccacccccggccagaaggtcaccatctcctgctccggctcccgctccaacatcggctcccactacgtctcctggtaccagcagttccccgagtccgcccccaccctcctcatctacgagaacgtcgagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16859 - RNA, 333 nt, synthetic construct
  misc_feature 1..333: note = derived and/or modified sequence opt2 from anti-HIV-1_LightChain
  source 1..333: mol_type = other RNA
cagttcttcctcacccagcccccctccctctccgccacccccggccagcgcgtctccatctcctgctccggcggcggctccaacatcgccaacaacgacgtcttctggttccagcagttccccggcgccggcccccgcctcctcatctacgacaacctcaagcgccactacggcacccccgaccgcttctccggctccaagtccggcgccaccggcaccctcgagatcaccgaggtccagaccgccgacgaggccgactactactgcggcacctgggactcctccctctccgccggcggcgtcttcggcaccggcaccaaggtcaccgtcctc

SEQ ID NO: 16860 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggcggctcctccaacatcggcgacaactccgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccaccggcggcgtcttcggcaccggcaccaaggtcaccgtcctc

SEQ ID NO: 16861 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaccgtcaccatctcctgctccggctccgcctccaacatcggccgcaactccgtctcctggtaccagtacgtccccggcgccgcccccaagcgcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 16862 - RNA, 333 nt, synthetic construct
  misc_feature 1..333: note = derived and/or modified sequence opt2 from anti-HIV-1_LightChain
  source 1..333: mol_type = other RNA
cagtccgtcctcgcccagcccccctccgtctccgccgcccccggccagaaggtcaccatctcctgctccggccgcacctccaacatcggcaactacttcgtctcctggtaccagcagttccccggcaccgccccccgcctcctcatctacgacaacgaccagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16863 - RNA, 333 nt, synthetic construct
  misc_feature 1..333: note = derived and/or modified sequence opt2 from anti-HIV-1_LightChain
  source 1..333: mol_type = other RNA
cagtccgccctcacccagcccgcctccgtctccgccgcccccggccagaaggtcaccatctcctgctccggctcctcctccaacatcggcaacatctacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16864 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccacccccggccagcgcgtcaccgtctcctgctccggctcctcctccaacatcggcaaccactacgtctcctggtaccagcaggtccccggcaccgcccccaagctcctcatctacgacaactccaaccgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16865 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccctctccgccgcccccggccagcgcgtcaccgtctcctgctccggctcctcctccaacatcggcgacaactacgtctcctggtaccagcagctccccggcgccgccccccgcctcctcatctacgacaactccatccgcccctccgccatccccgcccgcttctccggctccaagtccggcacctccgccaccctcgccatcaccggcctccagaccggcgacgaggccgactactactgcggcacctgggactcctccctctccgccggcggcgtcttcggcaccggcaccaaggtcaccgtcctc

SEQ ID NO: 16866 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccgcctccgtctccggctcccccggccagtccatcaccatctcctgcaccggcacctcctccgacgtcggcggctacgactacgtctcctggtacctccagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16867 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccgtctcctgctccggctcctcctccaacatcggcaacaactacgtctcctggtaccagcagttccccggcaccgcccccaagctcgtcatctacgacaccgacaagcgcccctccggcatccccgaccgcttctccggctccaagtccggcacctccgccaccctcggcatcaccggcctccagaccggcgacgaggccgactactactgcgccacctgggactcctccctctccgccggcggcgtcttcggcaccggcaccaaggtcaccgtcctc

SEQ ID NO: 16868 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatctcctgcaccggcaactcctccaacatcggcgccggctacgacgtccactggtaccagcagctccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16869 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccggcacccccggccagcgcgtcaccatctcctgctccggctcctcctccaacatcggctccaactacgtcgactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16870 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccacccccggccagaccgtcaccatctcctgctccggctcctcctccaacatcggcaacaactacctctcctggtaccgccagctcccccgcaccgcccccaagctcctcatctacgagaacaaccgccgcccctccggcgtccccgcccgcttctccggctccaagtccggcacctccgccaccctcgccatcaccggcctccagaccggcgacgaggccgactactactgcggcacctgggactcctccctctccgccggcggcgtcttcggcaccggcaccaaggtcaccgtcctc

SEQ ID NO: 16871 - RNA, 321 nt, synthetic construct
  misc_feature 1..321: note = derived and/or modified sequence opt2 from anti-HIV-1_LightChain
  source 1..321: mol_type = other RNA
cagtccgtcctcacccagcccccctccgtctccgccgcccccggccagcgcgtcaccatctcctgcttcggctcccgcttctcctccgtctcctggtaccagcagctccccggcaccgcccccaagctcctcatctaccccaacggcgagcgcccctccggcatccccgaccgcttcttcggctccgagtccggcacctccgccaccctcggcatcaccgccgtccagaccggcgacgaggccgactactactgcggcacctgggacgactccctctccaccggcggcgtcttcggcaccggcaccaaggtcaccgtcctc

SEQ ID NO: 16872 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccctctcctgctccggcacctcctccaacatcggcaacaactacgtctcctggtaccagcaggtccccggcgccgcccccaaggtcctcatctacgagaacgacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16873 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctccaactccaacatcggcaacaactacgtctcctggtaccagcagctccccggcaccgccaccaagctcctcatctacgagaacgacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16874 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccctctccgccgcccccggccagcaggtctccatctcctgcctcggccgctcctccaacatcggcaccaactacgtctcctggtaccagcagttccccggcaccgcccccaagctcctcatctacgagaacaagaagcgcccctccgagatccccgaccgcttctccggctccaagtccggcacctccgccaccctcggcatcaccggcctccagcccggcgacgaggccgactactactgcggcacctgggactcctccctctccgccggcggcgtcttcggcaccggcaccaaggtcaccgtcctc

SEQ ID NO: 16875 - RNA, 336 nt, synthetic construct
  misc_feature 1..336: note = derived and/or modified sequence opt2 from anti-HIV-1_LightChain
  source 1..336: mol_type = other RNA
cagtccgccctcacccagcccccctccgcctccggctcccccggccagtccgtcaccatctcctgcaccggcacctcctccgacgtcggcgcctacaactccgtctcctggtaccagcagctccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16876 - RNA, 333 nt, synthetic construct
  misc_feature 1..333: note = derived and/or modified sequence opt2 from anti-HIV-1_LightChain
  source 1..333: mol_type = other RNA
cagtccgccctcacccagcccccctccgcctccggctcccccggccagtccgtcaccatctcctgctccggcggctcctccaacatcggcaacaaccacgtctcctggtaccagcacctccccggccgcgccccccagctcctcatctacgacaccacccagcgcccctcccgcatccccgaccgcttctccggctcccgctccggcacctccgccaccctcgccatcaccggcctccagaccggcgacgaggccgtctactactgcggcacctgggacaactccctctccaccggcggcgtcttcggcaccggcaccaaggtcaccgtcctc

SEQ ID NO: 16877 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccatctcctgctccggcggcacctccaacatcggcaacgagtacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16878 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagcgcgtcaccgtctcctgctccggctcctcctccaacatcggcaacaactacgtctcctggtaccagcagctccccggcgccgcccccaagctcctcatctacgacaccgacaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16879 - RNA, 333 nt, synthetic construct
  misc_feature 1..333: note = derived and/or modified sequence opt2 from anti-HIV-1_LightChain
  source 1..333: mol_type = other RNA
cagtccctcctcacccagcccccctccgtctccgccgcccccggccagaaggtcaccatctcctgctccggcggcaactccgacatcggcaagaacttcgtctcctggtaccagcagtcccccggcgccgccccccgcctcctcatctacgagaacgaccgccgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16880 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaacatctcctgctccggctcctcctccaacatcggcaagaactacgtctcctggtaccagcagatccccggcaccgcccccaaggtcctcatctacgagaacaacaagcgcccctccggcatccccgaccgcttctccggctccaagtccggcacctccgccaccctcggcatcgccggcctccagaccggcgacgaggccgactactactgcgccacctgggactcctccctctccgccggcggcgtcttcggcaccggcaccaaggtcaccgtcctc

SEQ ID NO: 16881 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggcaaccgccacgtctcctggtaccagcagctccccggcaccgtccccaagctcctcatctacgagaccaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16882 - RNA, 336 nt, synthetic construct
  misc_feature 1..336: note = derived and/or modified sequence opt2 from anti-HIV-1_LightChain
  source 1..336: mol_type = other RNA
cagtccgtcctcacccagcccccctccgtctccggcgcccccggccagcgcgtcaccatctcctgcaccggctcctcctccaacatcggcgccggctacgacgtccactggtaccagcagctccccggcaccgcccccaagctcctcatcttcggccacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16883 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagctcccctccgcctccggcctccccggccagaccgtcaccatctcctgctccggctccacctcctccatcggctccaaccacgtctactggtaccagcaggtcgccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcgccacctgggactcctccctctccgccggcggcgtcttcggcaccggcaccaaggtcaccgtcctc

SEQ ID NO: 16884 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagaccccctccgcctccggcgcccccggccagggcgtcaccatctcctgctccggctcctcctccaacgtcggccgcaactacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16885 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagttccccggcaccgcccccaagctcctcatctccgacaacaacaagcgcccctccggcatccccgaccgcttctccgtctccaagtccggcacctccgccaccctcggcatcaccggcctccaggccggcgacgaggccgactactactgcggcacctgggactcctccctctccgccggcggcgtcttcggcaccggcaccaaggtcaccgtcctc

SEQ ID NO: 16886 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctccaactccaacatcggcaacaactacgtcacctggtaccagcagttccccggcaccgcccccaaggtcctcatctacgacaactcccgccgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 16887 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccggcgcccccggccagcgcgtcaccatctcctgctccggctcctcctccaacatcggcaacaactacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16888 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaccgtcaccatctcctgctccggctccacctccaacatcggccagaacttcctctcctggttccagcacgtccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16889 - RNA, 333 nt, synthetic construct
  misc_feature 1..333: note = derived and/or modified sequence opt2 from anti-HIV-1_LightChain
  source 1..333: mol_type = other RNA
aacttcatgctcacccagcccccctccgcctccggcacccccggccagcgcgtcaccatctcctgctccggctcctcctccaacatcggctccaagtacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16890 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagctcctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacaactccctctccaccggcggcgtcttcggcaccggcaccaaggtcaccgtcctc

SEQ ID NO: 16891 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagatcatcatctacgacaacaacaagcgcccctccggcatccccgaccgcttctccggctccaagtccggcacctccgccaccctcggcatcaccggcctccagaccggcgacgaggccgactactactgcggcacctggcactcctccctctccgccggcggcgtcttcggcaccggcaccaaggtcaccgtcctc

SEQ ID NO: 16892 - RNA, 333 nt, synthetic construct
  misc_feature 1..333: note = derived and/or modified sequence opt2 from anti-HIV-1_LightChain
  source 1..333: mol_type = other RNA
cagtccgtcctcacccagcccccctccgcctccgccacccccggccagcgcgtcaccatctcctgctccggctcctcctccaacatcggctccaagcacgtctactggtaccagaagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggaccgctccctctccgccggcggcgtcttcggcaccggcaccaaggtcaccgtcctc

SEQ ID NO: 16893 - RNA, 432 nt, synthetic construct
  misc_feature 1..432: note = derived and/or modified sequence opt2 from anti-HIV-1_HeavyChain
  source 1..432: mol_type = other RNA
caggcccagctcgtcgagtccggcggcggcgtcgtccagcccggccgctccctccgcctctcctgcgccgcctccggcttcaccttctcctcctacggcatccactgggtccgccaggcccccggcaagggcctcgagtgggtcgccgtcatgtcctccgacggcacctacaagtactacggcgactccatgaagggccgcttcaccatctcccgcgacaactccaagaactccctctacctccagatgaactccctccgcgccgtcgacaccgccgtctactactgcgccaaggacctcggcgagggcgagaacgaggagtgggccaccgactactacgacttctccatcggctaccccggccaggacccccgcggcgtcgtcggcaccttcgacatctggggccagggcaccatggtcaccgtctcctcc

SEQ ID NO: 16894 - RNA, 426 nt, synthetic construct
  misc_feature 1..426: note = derived and/or modified sequence opt2 from anti-HIV-1_HeavyChain
  source 1..426: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctccgacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttctggggccagggcaccatggtcaccgtctcctcc

SEQ ID NO: 16895 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagtccggccgctccctccgcctctcctgcgccgcctccggcttcaccttctccgcctacgccctccactgggtccgccaggcccccggcaagggcctcgagtgggtcgccgtcatctcctacgacggccgcgacaaggactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16896 - RNA, 432 nt, synthetic construct
  misc_feature 1..432: note = derived and/or modified sequence opt2 from anti-HIV-1_HeavyChain
  source 1..432: mol_type = other RNA
caggtccagctcgtccagtccggcggcggcctcgtccagcccggccgctccctccgcctctcctgcgtcgcctccggcttccgcttctccttccacggcatgcactgggtccgccaggcccccggcaagggcctcgagtgggtcgccgtcgtctccgacgacggctccgaccagaagtacgtcgactccgtcaagggccgcctcaccatctcccgcgacaactccaagaacaccgtctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16897 - RNA, 432 nt, synthetic construct
  misc_feature 1..432: note = derived and/or modified sequence opt2 from anti-HIV-1_HeavyChain
  source 1..432: mol_type = other RNA
gaggtccacctcgtcgagtccggcggcggcgtcgtccagcccggccgctccctccgcctctcctgcgccgcctccggcttcaccttcaactcctacgccatgatctgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcgccgaggacaccgccgtctaccactgcgccaaggacctcggcgagtccgagaacgaggagtgggcctccgactactacgacttcggccgcgactaccccggccaggacccccgcggcgtcgtcggcaccttcgacatctggggccacggcaccatggtcaccgtctcctcc

SEQ ID NO: 16898 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccgccccggcggctccctccgcctctcctgcaccgcctccggcttccacttcaacaagtacggcatgaactgggtccgccaggcccccggcaagggcctcgccctcgtcgccttcatccagtccggcgcctcctacaactactacgccgactccgtcaagggccgcttcaccatctcccgcgacaactccaagaacaccctctacctccagatgaactccctccgcgccgaggacaccgccgtctactactgcgccaaggacctcggcgactccgagaacgaggagtgggcctccgactactacgacttcggccgcgactaccccggccaggacccccgcggcgtcgtcggcgccttcgacatctggggccacggcaccatggtcaccgtctcctcc

SEQ ID NO: 16899 - RNA, 432 nt, synthetic construct
  misc_feature 1..432: note = derived and/or modified sequence opt2 from anti-HIV-1_HeavyChain
  source 1..432: mol_type = other RNA
caggtccacctcgtcgagtccggcggcggcgtcgtccagcccggcaagtccctcaccatctactgcgccgtctccgagttcaccctctccaactacgccatgcactgggtccgcctcacccccggcaagggcctccagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggccgcgactaccccggccaggacccccgcggcgtcgtcggcgtcttcgacatctggggccagggcaccatggtcaccgtctcctcc

SEQ ID NO: 16900 - RNA, 432 nt, synthetic construct
  misc_feature 1..432: note = derived and/or modified sequence opt2 from anti-HIV-1_HeavyChain
  source 1..432: mol_type = other RNA
gaggtccagctcctcgagtccggcggcggcgtcgtccagcccggccgctccctccgcctctcctgcgccgcctccggcttcaccttctccacctacgccctccactgggtccgccaggcccccggcaagggcctcgagtgggtcgccgtcatctcctacgacggctccaccaagttctacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16901 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcatccgctacgacggctccaacaagtactacgccgactccgtcaagggccgcttcaccatctcccgcgagaactccaagaacaccctctacctccagatgaactccctccgcgccgaggacaccgccgtctaccactgcgccaaggacctcggcgagtccgagatcgaggagtggacctccgactactacgacttcggccgcgactaccccggccaggacccccgcggcgtcttcggcaccttcgacatctggggccacggcaccatggtcaccgtctcctcc

SEQ ID NO: 16902 - RNA, 432 nt, synthetic construct
  misc_feature 1..432: note = derived and/or modified sequence opt2 from anti-HIV-1_HeavyChain
  source 1..432: mol_type = other RNA
gaggtccagctcgtcgagtccggcggcggcgtcgtcaagcccggcggctccctccgcctctcctgcgtcgtctccggcttcaccttctccaacgcctggatgtcctgggtccgccaggcccccggcaagggcctcgagtgggtcgccgtcatctccgacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16903 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgccgcctccggcttcaccttctccacctacggcatgcactgggtccgccaggcccccggcaagggcctcgagtgggtcgccttcatccgctacgacggccgcaacaagaactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctccatcggctaccccggccaggacccccgcggcgtcgtcggcatcttcgacatctggggccagggcaccatggtcaccgtctcctcc

SEQ ID NO: 16904 - RNA, 432 nt, synthetic construct
  misc_feature 1..432: note = derived and/or modified sequence opt2 from anti-HIV-1_HeavyChain
  source 1..432: mol_type = other RNA
caggtccacctcgtcgagtccggcggcggcgtcgtccagcccggcggctccctccgcctctcctgcgccgcctccggcttctccttctccatctacggcatgcactgggtccgccaggcccccggcaagggcctcgagtgggtcaccttcacccgctacgacggctccaacaagtactacaccgactccgtcaagggccgcttcaccatctcccgcgacaactccaagaacaccctctacctccagatgaactccctccgcaccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16905 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcatccgctacgacggctccaacaagtactacgccgaccccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggccgcgactaccccggccaggacccccgcggcgtcgtcggcgtcttcgacatctggggccagggcaccatggtcaccgcctcctcc

SEQ ID NO: 16906 - RNA, 432 nt, synthetic construct
  misc_feature 1..432: note = derived and/or modified sequence opt2 from anti-HIV-1_HeavyChain
  source 1..432: mol_type = other RNA
gagatgcagctcgtcgagtccggcggcggcctcgtccagcccggcggctccctccgcctctcctgcgccgcctccggcttcaccttctcctcctactggatgtcctgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcggcgtcgtcggcaccttcgacatctggggccacggcaccatggtcaccgtctcctcc

SEQ ID NO: 16907 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctcctcctgcgccatgcactgggtccgccaggcccccggcaagggcctcgagtgggtcgccgtcatctcctacgacggcaacaacaagcactacgccgactccgtcaagggccgcttcaccatctcccgcgacaactccaagaacaccctctacctccagatgaactccctccgcgccgaggacatggccgtctactactgcgccaaggacctcggcgagtccgagaacgaggagtgggcctccgactactacgacttctggcgcgactaccccggccaggacccccgcggctgggtcggcaccttcgacatctggggccagggcaccatggtcaccgtctcctcc

SEQ ID NO: 16908 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctccaactacggcatgcactgggtccgccaggcccccggcaagggcctcgagtgggtcaccgtcatctcctccgacggctccaagaagtactacgccgactccgtcaagggccgcttcaccatctcccgcgacaactccaagaacaccctctacctccagatgaacggcctccgcgccgacgacaccgccgtctactactgcgccaaggacctcggcgactccgagaacgaggagtgggcctccgactactacgacttcggccgcgactaccccggccaggacccccgcggcgtcgtcggcgccttcgacatctggggccacggcaccatggtcaccgtctcctcc

SEQ ID NO: 16909 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcatccgctacgacggctccaacaagtactacgccgactccgtcaagggccgcttcaccatctcccgcgacaactccaagaacaccctctacctccagatgaactccctccgcgccgtcgacaccgccgtctactactgcgccaaggacctcggcgagggcgagaacgaggagtgggccaccgactactacgacttctccatcggctaccccggccaggacccccgcggcgtcgtcggcgccttcgacatctggggccagggcaccatggtcaccgtctcctcc

SEQ ID NO: 16910 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttccgcaactacggcatgcactgggtccgccagtcccccggcaagggcctcgagtgggtcgccgtcatctcctacgacggcaagatcatcaactacatcgacttcgtcaagggccgcttcaccatctcccgcgagaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcggcgtcgtcggcaccttcgacatctggggccacggcaccatggtcaccgtctcctcc

SEQ ID NO: 16911 - RNA, 432 nt, synthetic construct
  misc_feature 1..432: note = derived and/or modified sequence opt2 from anti-HIV-1_HeavyChain
  source 1..432: mol_type = other RNA
gaggtccagctcctcgagtccggcggcggcctcgtccagcccggccgctccctccgcctctcctgcgccgcctccggcttcaccttctcctcctacgtcatgcactgggtccgccaggcccccggcaagggcctcgagtgggtcgccgtcatctcctacgacggctccaacaagcactacgccgactccgtcaagggccgcttcaccatctcccgcgacaactccaagaacaccctctacctccagatgaactccctccgcgccgaggacaccgccgtctactaccgcgccaaggacctcggcgagtccgagaacgaggagtgggcctccgactactacgacttcggccgcgactaccccggccaggacccccgcggcgtcgtcggcgtcctctacatctggggccagggcaccatggtcaccgtctcctcc

SEQ ID NO: 16912 - RNA, 432 nt, synthetic construct
  misc_feature 1..432: note = derived and/or modified sequence opt2 from anti-HIV-1_HeavyChain
  source 1..432: mol_type = other RNA
gaggtccagctcgtcgagtccggcggcggcctcgtcaagcccggcggctccctccgcctctcctgcgccgcctccggcttcaccttctccacctactccatgcactgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcgccgaggacaccgccgtctaccactgcgccaaggacctcggcgagtccgagaacgaggagtgggcctccgactactacgacttcggccgcgactaccccggccaggacccccgcggcgtcgtcggcaccttcgacatctggggccacggcaccatggtcaccgtctcctcc

SEQ ID NO: 16913 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgactccggcggcggcgtcgtccagcccggccgctccctccgcctcttctgcgccgtctccggcttcaccttctccacctacaccatgcactgggtccgccaggcccccggccgcggcctcgagtgggtcgccgtcatctcctacgacggctccaccaagtactacgccgactccgtccagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16914 - RNA, 426 nt, synthetic construct
  misc_feature 1..426: note = derived and/or modified sequence opt2 from anti-HIV-1_HeavyChain
  source 1..426: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgccccgaggacaccgccgtctactactgcgccaaggacctcggcgagtccgagaacgaggagtgggcctccgactactacgacttcggccgcgactaccccggccaggacccccgcggcgtcgtcggcaccttcgacatctggggccacggcaccatggtcaccgtc

SEQ ID NO: 16915 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcatgttctcccgctacggcatgcactgggtccgccaggcccccggcaagggcctcgagtgggtcgccgtcatctcccacgacggctccaacaagtactacgccgactccgtcaagggccgcttcatcatctcccgcgacaactccaagaacaccctctacctccagatgaactccctccgcgccgacgacaccgccgtctactactgcgccaaggacctcggcgagtccgagaacgaggagtgggcctccgactactacgacttctggatcggctaccccggccaggacccccgcggcgtcgtcggcgccttcgacatctggggccagggcaccatggtcaccgtctcctcc

SEQ ID NO: 16916 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgccgcctccgccttcaccttctcctcctacggcatgcactgggtccgccaggcccccggcaagggcctcgagtgggtcgccttcatccgctacgacggctccaacaagtactacgccgactccgtcaagggccgcttcaccatctcccgcgacaactccaagaacaccctcttcctccagatgaactccctccgcgccgaggacatggccgtctactactgcgccaaggacctcggcgagtccgagaacgaggagtgggcctccgactactacgacttctggcgcgactaccccggccaggacccccgcggctgggtcggcaccttcgacatctggggccagggcaccatggtcaccgtctcctcc

SEQ ID NO: 16917 - RNA, 426 nt, synthetic construct
  misc_feature 1..426: note = derived and/or modified sequence opt2 from anti-HIV-1_HeavyChain
  source 1..426: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgccgtcatctcctacgacggctccaacaagtactacgtcgactccgtcaagggccgcttcaccatctcccgcgacaactccaagaacaccctctacctccagatgaactccctccgcgccgaggacaccgccgtctacgccaaggacctcggcgagtccgagaacgaggagtgggcctccgactactacgacttcggctccgactaccccggccaggacccccgcggcgtcgtcggcaccttcgacatctggtcccagggcaccatggtcaccgtctcctcc

SEQ ID NO: 16918 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgccgcctccggcttcaccttctccacctacggcatgcactgggtccgccaggcccccggcaagggcctcgactgggtcgccttcatccgctacgacggctcccacaagtactacgccgactccgtcaagggccgcttcaccatctcccgcgagaactccaagaacaccctctacctccagatgaactccctccgccccgaggacaccgccgtctactactgcgccaaggacctcggcgagtccgagaacgaggagtgggcctccgactactacgacttcggccgcgactaccccggccaggacccccgcggcgtcgtcggcaccttcgacatctggggccacggcaccatggtcaccgtctcctcc

SEQ ID NO: 16919 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctccggcgactactacgccgactccgtcaagggccgcttcaccatctcccgcgacaactccaagtccaccctctacctccagatgaactccctccgccccgaggacaccgccgtctactactgcgccaaggacctcggcgagtccgagaacgaggagtgggcctccgactactacgacttcggccgcgactaccccggccaggacccccgcggcgtcgtcggcaccttcgacatctggggccacggcaccatggtcaccgtctcctcc

SEQ ID NO: 16920 - RNA, 432 nt, synthetic construct
  misc_feature 1..432: note = derived and/or modified sequence opt2 from anti-HIV-1_HeavyChain
  source 1..432: mol_type = other RNA
caggtccacctcgtcgagtccggcggcggcgtcgtccagcccggcggctccctccgcctctcctgcgccgcctccggcttcaccttctccacctacggcatgcagtgggtccgccaggcccccggcaagggcctcgagtgggtcgccttcatcaagaacgacggcaccaacgagttctacggcgactccgtcaagggccgcttcaccatctcccgcgacaactccaagaacaccgtctccctccacatggactccctccgccccgaggacaccgccctctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16921 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgtcgcctccggcttcaccttctcctcctacggcatgcactgggtccgccaggcccccggcaagggcctcgagtgggtcgccttcatccgctacgacggccgcaacaagtactacgccgactccgtcaagggccgcttcaccatctcccgcgacaagtccaagaacaccctctgcctccagatgaactccctccgcgtcgaggacaccgccgtctactactgcgccaaggacctcggcgactccgagaacgaggagtgggcctccgactactacgacttcggccgcgactaccccggccaggacccccgcggcgtcgtcggcgccttcgacatctggggccacggcaccatggtcaccgtctcctcc

SEQ ID NO: 16922 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctcctacgacggctccaacaagtactaccgcgactccgtcaagggccgcttcaccatctcccgcgacaactccaagaacaccgtctacctccagatgaactccctccgcgccgaggacaccgccgtctactactgcgccaaggacctcggcgagtccgagtccgaggagtgggcctccgactactacgacttcggccgcgactaccccggccaggacccccgcggcgtcgtcggcgccctcgacatctggggccagggcatcatggtcaccgtctcctcc

SEQ ID NO: 16923 - RNA, 432 nt, synthetic construct
  misc_feature 1..432: note = derived and/or modified sequence opt2 from anti-HIV-1_HeavyChain
  source 1..432: mol_type = other RNA
gaggtccagctcgtcgagtccggcggcggcatggtccagcccggccgccccctccgcctctcctgcgccgcctccggcttcatcttctccggcttcggcctccactgggtccgccaggcccccggcaagggcctcgagtgggtcgcctccatctcctacgacggcggcaacaagtactacgccgactccgtccgcggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16924 - RNA, 432 nt, synthetic construct
  misc_feature 1..432: note = derived and/or modified sequence opt2 from anti-HIV-1_HeavyChain
  source 1..432: mol_type = other RNA
gaggtccagctcgtcgagtccggcggcggcgtcgtccgccccggcggctccctccgcctctcctgcgccgcctccggcttcaccttcaacgactacggcatggcctgggtccgccaggcccccggcaagggcctcgagtgggtcgccgacatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggccgcgactaccccggccaggacccccgcggcgtcgtcggcgccttcgacatctggggccagggcaccatggtcaccgtctcctcc

SEQ ID NO: 16925 - RNA, 429 nt, synthetic construct
  misc_feature 1..429: note = derived and/or modified sequence opt2 from anti-HIV-1_HeavyChain
  source 1..429: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcgtctcctacgacgagtccaagtactacgccgactccgtcaagggccgcttcaccatctcccgcgacaactccaagaacaccctctacctccagatgaactccctccgcgccgaggacatggccgtctactactgcgccaaggacctcggcgagtccgagaacgaggagtgggcctccgactactacgagttctggcgcgactaccccggccaggacccccgcggctgggtcggcaccttcgacatctggggccagggcaccatggtcaccgtctcctcc

SEQ ID NO: 16926 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagcccggccgcggcgtcgtccaccccggcggctccctccgcctctcctgcgtcacctccggcttcaccttcgagaacttccccatgcactgggtccgccaggcccccggcaagggcctcgagtgggtcgccctcatctcctacgacggctccgacaagtactactccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcggcgtcgtcggcaccttcgacatctggggccacggcaccatggtcaccgtctcctcc

SEQ ID NO: 16927 - RNA, 432 nt, synthetic construct
  misc_feature 1..432: note = derived and/or modified sequence opt2 from anti-HIV-1_HeavyChain
  source 1..432: mol_type = other RNA
caggcccagctcgtcgagtccggcggcggcgtcgtccagcccggccgctccctccgcctctcctgcgccgcctccggcttctccttcgccacccacgccatgcactgggtccgccgctcccccggcaagggcctcgagtgggtcgccaccatctcctacggcggcaagaacgagtactacgccgactccgtcaagggccgcttcaccatctcccgcgagaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcggcgtcgtcggcaccttcgacatctggggccacggcaccatggtcaccgtctcctcc

SEQ ID NO: 16928 - RNA, 432 nt, synthetic construct
  misc_feature 1..432: note = derived and/or modified sequence opt2 from anti-HIV-1_HeavyChain
  source 1..432: mol_type = other RNA
gccgtccagctcgtcgagtccggcggcggcctcgtcaagcccggcggctccctccgcctctcctgcgccgcctccggcttcaccttcttcaacacctggatgtcctgggtccgccagtcccccggcaagggcctcgagtgggtcgccgacatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggccgcgactaccccggccaggacccccgcggcgtcgtcggcgtcttcgacatctggggccagggcaccatggtcaccgtctcctcc

SEQ ID NO: 16929 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcgccgtcgtcggcgccttcgacatctggggccagggcaccatggtcaccgtctcctcc

SEQ ID NO: 16930 - RNA, 432 nt, synthetic construct
  misc_feature 1..432: note = derived and/or modified sequence opt2 from anti-HIV-1_HeavyChain
  source 1..432: mol_type = other RNA
caggtccgcctcgtcgagtccggcggccgcgtcgtccagcccggcggctccctccgcctctcctgcgtcgcctccggcttcaccttctcctcctacggcatccactgggtccgccaggcccccggcaagggcctcgagtgggtcaccttcatctggcacgacggccgcgacacctactacgccgacgccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctggaccggctaccccggccaggacccccgcgccgtcgtcggcgccttcgacatctggggccagggcaccatggtcaccgtctcctcc

SEQ ID NO: 16931 - RNA, 432 nt, synthetic construct
  misc_feature 1..432: note = derived and/or modified sequence opt2 from anti-HIV-1_HeavyChain
  source 1..432: mol_type = other RNA
caggtccacctcgtcgagtccggcggcggcgtcgtccagcccggccgctccctccgcatctactgcgccgtctccgagttcaccttccgcaactacgccatgcactgggtccgcctcgcccccggcaagggcctccagtgggtcgccgtcatctcctacgacggctccaacaagtactacggcgactccgtcaagggccgcttcaccatctcccgcgacaactccaagaacaccctctacctccagatggactccctccgcgccgaggacaccgccgtctactactgcgccaaggacctcggcgagtccgagaacgaggagtgggcctccgactactacgacttcggccgcgactaccccggccaggacccccgcggcgtcgtcggcaccttcgacatctggggccacggcaccatggtcaccgtctcctcc

SEQ ID NO: 16932 - RNA, 432 nt, synthetic construct
  misc_feature 1..432: note = derived and/or modified sequence opt2 from anti-HIV-1_HeavyChain
  source 1..432: mol_type = other RNA
gaggtccagctcgtcgagtccggcggcggcctcgtcaagcccggcggctccctccgcctctcctgcgccgcctccggcttcaccttctccgacgcctggatgtcctgggtccgccaggcccccggcaagggcatggagtgggtcgccgtcatctcctacgacggctccaacaagtactacgccgactccgtcaagggccgcttcaccatctcccgcgacaactccaagaacaccctctacctccagatgaactccctccgcgccgtcgacaccgccgtctactactgcgccaaggacctcggcgagggcgagaacgaggagtgggccaccgactactacgacttctccatcggctaccccggccaggacccccgcggcgtcgtcggcgccttcgacatctggggccagggcaccatggtcaccgtctcctcc

SEQ ID NO: 16933 - RNA, 432 nt, synthetic construct
  misc_feature 1..432: note = derived and/or modified sequence opt2 from anti-HIV-1_HeavyChain
  source 1..432: mol_type = other RNA
gaggtccaggtcgtcgagtccggcggcggcctcgtcaagcccggcggctccctccgcctctcctgcgaggcctccggcttcaccttctccaacgcctggatgtcctgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcgccgaggacaccgccgtctaccactgcgccaaggacctcggcgagtccgagaacgaggagtgggcctccgactactacgacttcggccgcgactaccccggccaggacccccgcggcgtcgtcggcaccttcgacatctggggccacggcaccatggtcaccgtctcctcc

SEQ ID NO: 16934 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggcggctccctccgcctctcctgcgccgcctccggcttcaccttctcctcctacggcatccactgggtccgccaggcccccggcaagggcctcgagtgggtcgccttcatccgctccgacgccaccaacaagtactacgccgactccgtcaagggccgcttcaccatctcccgcgagaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcggcgtcgtcggcaccttcgacatctggggccacggcaccatggtcaccgtctcctcc

SEQ ID NO: 16935 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcgccgaggacaccgccgtctactactgcgccaaggacctcggcgagtccgagaacgaggagtgggcctccgactactacgacttcggctccgactaccccggccaggacccccgcggcgtcgtcggcaccttcgacatctggggccacggcaccatggtcaccgtctcctcc

SEQ ID NO: 16936 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctccaactacgccatggactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctggaccggctaccccggccaggacccccgcgccgtcgtcggcgccttcgacatctggggccagggcaccatggtcaccgtctcctcc

SEQ ID NO: 16937 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcgtctcctacgacgagtccaacaagtactacgccggctccgtcaagggccgcttcaccatctcccgcgacaactccaagaacaccctctacctccagatgaactccctccgcaccgaggacatggccgtctactactgcgccaaggacctcggcgagtccgagaacgaggagtgggcctccgactactacgacttcggccgcgagtaccccggccaggacccccgcggctgggtcggcaccttcgacatctggggccagggcaccatggtcaccgtctcctcc

SEQ ID NO: 16938 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctcctacgacggctccaacaagtactacgtcgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctccatcggctaccccggccaggacccccgcggcgtcgtcggcatcttcgacatctggggccagggcaccatggtcaccgtctcctcc

SEQ ID NO: 16939 - RNA, 432 nt, synthetic construct
  misc_feature 1..432: note = derived and/or modified sequence opt2 from anti-HIV-1_HeavyChain
  source 1..432: mol_type = other RNA
caggtccagctcgtcgagtccggcggcggcgtcgtccagcccggccgctccctccgcctctcctgcgccgcctccggcttcaccttctccacctccggcatgcactgggtccgccaggcccccggcaagggcatggagtgggtcgccgtcatctcctacgacggctccaacaagtactacgccgactccgtcaagggccgcttcaccatctcccgcgacaactccaagaacaccctctacctccagatgaactccctccgcgccgtcgacaccgccgtctactactgcgccaaggacctcggcgagggcgagaacgaggagtgggccaccgactactacgacttctccatcggctaccccggccaggacccccgcggcgtcgtcggcgccttcgacatctggggccagggcaccatggtcaccgtctcctcc

SEQ ID NO: 16940 - RNA, 363 nt, synthetic construct
  misc_feature 1..363: note = derived and/or modified sequence opt2 from anti-HIV_C38-VRC18.02_HeavyChain
  source 1..363: mol_type = other RNA
caggtccgcctcgtccagtccggcaaccaggtccgcaagcccggcgcctccgtccgcatctcctgcgaggcctccggctacaagttcatcgaccacttcatccactgggtccgccaggtccccggccacggcctcgagtggctcggctggatcaacccccgcggcggcggcgtcaactactcccgctccttccagggcaagctctccatgaccatgacccgcgacaacttcgaggagaccgcctacctcgacctctccaagctcaaccccggcgacaccgccgtctacttctgcgcccgcggcttcgccggctacgagtggtccttcatctggggccagggcaccctcgtcatcgtctcctcc

SEQ ID NO: 16941 - RNA, 396 nt, synthetic construct
  misc_feature 1..396: note = derived and/or modified sequence opt2 from anti-HIV_44-VRC13.02_HeavyChain
  source 1..396: mol_type = other RNA
caggtccagctcgtccagtccggcaccgccctcaagtcccccggctcctccgccaagctctcctgcaccgtcctcggcgacgagttcggcacctacttcatctcctggatccgccaggcccccggccagggcctcgagtgggtcggcggcatcgtcccccactcccagctccagtcctccgcccagaagttccacggccgcatcatcatctccgccggcgccggcgtcaccccccccgtcgtctccctccagctcaccaacctcaccttcgaggacaccggcacctacttctgcgcccgcgagcgcggccgccaccgcgaccccaagaccggcgacgccctccgcggccgctacttcgacttctggggccgcggcaccggcctccgcgtctccacc

SEQ ID NO: 16942 - RNA, 321 nt, synthetic construct
  misc_feature 1..321: note = derived and/or modified sequence opt2 from anti-HIV-1_LightChain
  source 1..321: mol_type = other RNA
gacatcaagctcacccagtcccccgccttcctctccgcctccgtcggcgagcgcgtcaccttcacctgccgcgcctcccaggacatctcccacgacctcgtctggttccagcagaaggccggccgcgccccctccctcctcatgttctacggctccaccctcgagcgcggcgtccccccccgcttctccggccgccgctccggcaccgagttcaccgtcaccatcgactccctccagcccgaggacgtcggcacctactactgccagcagctctccgccttccccctcaccttcggcggcggcaccaccgtcgacatcaag

SEQ ID NO: 16943 - RNA, 321 nt, synthetic construct
  misc_feature 1..321: note = derived and/or modified sequence opt2 from anti-HIV-1_LightChain
  source 1..321: mol_type = other RNA
gacatcaagatgacccagtcccccgccttcctctccgcctccgtcggcgagcgcgtcaccttcacctgccgcgcctcccaggacatctcccacgacgtcgtctggttccagcagaagtccggctccgcccccaagctcctcatgttctacggctccaccctcgagcgcggcgtccccccccgcttctccggccgccgctccggcaccgagttcaccgtcaccatcgacggcctccagcccgaggacgtcggcacctactactgccagcagctctccgccttccccctcaccttcggcggcggcaccaccgtcgacatcaag

SEQ ID NO: 16944 - RNA, 321 nt, synthetic construct
  misc_feature 1..321: note = derived and/or modified sequence opt2 from anti-HIV-1_LightChain
  source 1..321: mol_type = other RNA
gacatcaagctcacccagtcccccgccttcctctccgcctccgtcggcgagcgcgtcaccttcacctgccgcgcctcccaggacatccgccacgagctcgtctggtaccagcagaagcccggccgcggccccaagctcctcatctactacggctccaccctcgagggcggcgtcccctcccgcttctccggccgccgctccggcaccgagttcaccgtcaccatctcctccctccagcccgaggacgtcggcacctactactgccagcagctcaactccttccccctcaccttcggcggcggcaccaccgtcgacatccgc

SEQ ID NO: 16945 - RNA, 321 nt, synthetic construct
  misc_feature 1..321: note = derived and/or modified sequence opt2 from anti-HIV-1_LightChain
  source 1..321: mol_type = other RNA
gacatccagctcacccagtccccctccttcctctccgcctccgtcggcgaccgcgtctccatcacctgccgcgcctcccagggcatcaagcacgagctcgcctggtaccagcagaagcccggccgcgccccctccctcctcatctactacgcctccaccctcgcccgcggcgtcccctcccgcttctccgcctcctggtccggcaccctcttcaccctcaccatcaacggcctccagcccgaggacttcgccacctacttctgccagcagatgaactccctccccctcaccttcggcggcggcaccaagatggacgtccgc

SEQ ID NO: 16946 - RNA, 321 nt, synthetic construct
  misc_feature 1..321: note = derived and/or modified sequence opt2 from anti-HIV-1_LightChain
  source 1..321: mol_type = other RNA
gacatccagctcacccagtccccctccttcctctccgcctccgtcggcgacaaggtcaccatcacctgccgcgcctcccacggcgtccgcaacgagctcgcctggtaccagcagaagcccggcaaggcccccaacctcctcatctactacgcctccaccctccagtccggcgtcccctcccgcttctccgccaccggctccggcacccacttcaccctcaccgtctcctccctccagcccgaggacttcgccacctacttctgccagcacatgtcctcctaccccctcaccttcggcggcggcaccaaggtcgagatcaag

SEQ ID NO: 16947 - RNA, 321 nt, synthetic construct
  misc_feature 1..321: note = derived and/or modified sequence opt2 from anti-HIV-1_LightChain
  source 1..321: mol_type = other RNA
gacatccagctcacccagtccccctccttcctctccgcctccgtcggcgacaaggtcaccttcacctgccgcgcctcccagggcgtccgcaacgagctcgcctggtaccagcagaagcccggcaaggcccccaacctcctcatctactacgcctccaccctccagtccggcgtcccctcccgcttctccgccaccggctccggcacccacttctccctcaccgtctcctccctccagcccgaggacttcgccacctacttctgccagcacatgtcctcctaccccctcaccttcggcggcggcaccaaggtcgagatcaag

SEQ ID NO: 16948 - RNA, 321 nt, synthetic construct
  misc_feature 1..321: note = derived and/or modified sequence opt2 from anti-HIV-1_LightChain
  source 1..321: mol_type = other RNA
gacatccagctcacccagtccccctccttcctctccgcctccgtcggcgacaaggtcaccatcacctgccgcgcctcccagggcgtccgcaacgagctcgcctggtaccagcagaagcccggcaaggcccccaacctcctcatctactacgcctccaccctccagtccggcgtcccctcccgcttctccgccaccggctccggcacccacttcaccctcaccgtctcctccctccagcccgaggacttcgccacctacttctgccagcacatgtcctcctaccccctcaccttcggcggcggcaccaaggtcgagatcaag

SEQ ID NO: 16949 - RNA, 366 nt, synthetic construct
  misc_feature 1..366: note = derived and/or modified sequence opt2 from anti-HIV-1_HeavyChain
  source 1..366: mol_type = other RNA
tcccagtacctcgcccagcccggcgccgaggtcgccaagcccggcgcctccgtcaaggtctcctgcaaggtccacggcgacaacttccgcggccactacctccactgggtccgccaggcccccggccagggcctccagtggatcggcggcatcaaccccttctccggcgaggccgcctacggcaagcgcttcgagggccgcctccgcctcacccgcgacacctccgtcaacaccgcctacatggagctcgccaagctcacccccgacgacaccgccgtctacttctgcgcccgcgacaagacctacaacgacgagttcaccgccatggacatctggggccacggcaccaccgtcatcgtctcctcc

SEQ ID NO: 16950 - RNA, 366 nt, synthetic construct
  misc_feature 1..366: note = derived and/or modified sequence opt2 from anti-HIV-1_HeavyChain
  source 1..366: mol_type = other RNA
tcccagtacctcgcccagcccggcgccgaggtcgccaagccctgggcctccgtcaaggtctcctgccgcgtccacggcgacaacttccgcggcttctacctccactgggtccgccaggcccccggccagggcctcgagtggatcggcggcatcaaccccttctccggcgaggccgcctacggccgccgcttcgagggccgcctccgcctcacccgcgacacctccatcaacaccgcctacatggaggtcaccaagctcacctccgacgacaccgccgtctacttctgcgcccgcgacaagacctacaacgacgagttcaccgccatggacatctggggccagggcaccaccgtcatcgtctcctcc

SEQ ID NO: 16951 - RNA, 366 nt, synthetic construct
  misc_feature 1..366: note = derived and/or modified sequence opt2 from anti-HIV-1_HeavyChain
  source 1..366: mol_type = other RNA
tcccagtacctcgcccagtccggctccgaggtcaagaagcccggcgcctccgtcaaggtctcctgccgcctccacggcgacaagttcggcgcccactacatccactgggtccgccaggcccccggccagggcctcgagtggctcggcttcttccaccccggcaccggcgacgccgtctccgcccagaagttccagggccgcatctccctcacccgcgacacctccatctccaccggctacctcgaggtccgccgcctctcctccgacgacaccgccgtctactactgcgcccgcgacaagacctactccgacgaggccaccggcatggacatctggggccagggcaccaccgtcatcgtctcctcc

SEQ ID NO: 16952 - RNA, 366 nt, synthetic construct
  misc_feature 1..366: note = derived and/or modified sequence opt2 from anti-HIV-1_HeavyChain
  source 1..366: mol_type = other RNA
tccctcgagctcgtccagtccggcaccgaggtcaagaagcccggcgcctccgtcaaggtctcctgcaagctcttcggcgacaccatcacctccggccccatccactgggtccgccaggcccccggccagggcctcgagtggatgggctggaccaacccccactccggcgacaccgccaccgcccccaagttccagggccgcgtctacatgaccaacgacaagaagatcaacaccgccttcctcgacgtcacccgcctcgcctccgacgacaccgccatctacttctgcgcccgcgacatgtactactccaacgaggccgtcggcatggacgtctggggccagggcaccaccgtctccgtctcctcc

SEQ ID NO: 16953 - RNA, 366 nt, synthetic construct
  misc_feature 1..366: note = derived and/or modified sequence opt2 from anti-HIV-1_HeavyChain
  source 1..366: mol_type = other RNA
caggaggtcctcgtccagtccggcgccgaggtcaagaagcccggcgcctccgtcaaggtctcctgccgcgccttcggctacaccttcaccgcccacgccctccactgggtccgccaggcccccggccagggcctcgagtggctcggctggatcaacccccactccggcgacaccaccacctcccagaagttccagggccgcgtctacatgacccgcgacaagtccatcaacaccgcctacctcgaggtcacccgcctcacctccgacgacaccgccatcttctactgcgcccgcgacaagtactacggcgacgaggccgtcggcatggacgtctggggccagggcacctccgtcaccgtctcctcc

SEQ ID NO: 16954 - RNA, 366 nt, synthetic construct
  misc_feature 1..366: note = derived and/or modified sequence opt2 from anti-HIV-1_HeavyChain
  source 1..366: mol_type = other RNA
caggaggtcctcgtccagtccggcgccgaggtcaagaagcccggcgcctccgtcaaggtctcctgccgcgccttcggctacaccttcaccggcaacgccctccactgggtccgccaggcccccggccagggcctcgagtggctcggctggatcaacccccactccggcgacaccaccacctcccagaagttccagggccgcgtctacatgacccgcgacaaggccatcaacaccgcctacctcgacgtcacccgcctcacctccgacgacaccgccatctactactgcgcccgcgacaagtactacggcaacgaggccgtcggcatggacgtctggggccagggcacctccgtcaccgtctcctcc

SEQ ID NO: 16955 - RNA, 366 nt, synthetic construct
  misc_feature 1..366: note = derived and/or modified sequence opt2 from anti-HIV-1_HeavyChain
  source 1..366: mol_type = other RNA
caggaggtcctcgtccagtccggcgccgaggtcaagaagcccggcgcctccgtcaaggtctcctgccgcgccttcggctacaccttcaccggcaacgccctccactgggtccgccaggcccccggccagggcctcgagtggctcggctggatcaacccccactccggcgacaccaccacctcccagaagttccagggccgcgtctacatgacccgcgacaagtccatcaacaccgccttcctcgacgtcacccgcctcacctccgacgacaccggcatctactactgcgcccgcgacaagtactacggcaacgaggccgtcggcatggacgtctggggccagggcacctccgtcaccgtctcctcc

SEQ ID NO: 16956 - RNA, 303 nt, synthetic construct
  misc_feature 1..303: note = derived and/or modified sequence opt2 from anti-HIV_45_LightChain
  source 1..303: mol_type = other RNA
tccctcacccagtcccccggcaccctctccctctcccccggcgagaccgccatcatctcctgccgcacctcccagtacggctccctcgcctggtaccagcagcgccccggccaggccccccgcctcgtcatctactccggctccacccgcgccgccggcatccccgaccgcttctccggctcccgctggggccccgactacaacctcaccatctccaacctcgagtccggcgacttcggcgtctactactgccagcagtacgagttcttcggccagggcaccaaggtccaggtcgacatcaag

SEQ ID NO: 16957 - RNA, 303 nt, synthetic construct
  misc_feature 1..303: note = derived and/or modified sequence opt2 from anti-HIV_45_LightChain
  source 1..303: mol_type = other RNA
gtcctcacccagtcccccggcaccctctccctctcccccggcgagaccgccaccatctcctgccgcacctcccagtacggctccctcgcctggtaccagcagcgccccggccaggccccccgcctcgtcatctactccggctccacccgcgccgccggcatccccgaccgcttctccggctcccgctccggccccgactacaccctcaccatctccaacctcgagtccggcgacttcggcgtctactactgccagcagtacgagttcttcggccagggcaccaaggtccagcaggacaacaag

SEQ ID NO: 16958 - RNA, 303 nt, synthetic construct
  misc_feature 1..303: note = derived and/or modified sequence opt2 from anti-HIV_45_LightChain
  source 1..303: mol_type = other RNA
gtcctcacccagtcccccggcaccctctccctctcccccggcgagaccgccatcatctcctgccgcacctcccagtacggctccctcgcctggtaccagcagcgccccggccaggccccccgcctcgtcatctactccggctccacccgcgccgccggcatccccgaccgcttctccggctcccgctggggccccgactacaacctcaccatctccaacctcgagtccggcgacttcggcgtctactactgccagcagtacgagttcttcggccagggcaccaaggtccaggtcgacatcaag

SEQ ID NO: 16959 - RNA, 363 nt, synthetic construct
  misc_feature 1..363: note = derived and/or modified sequence opt2 from anti-HIV_45_HeavyChain
  source 1..363: mol_type = other RNA
caggtccgcctctcccagtccggcggccagatgaagaagcccggcgagtccatgcgcatctcctgccgcgcctccggctacgagttcatcgactgcaccctcaactggatccgcctcgcccccggccgccgccccgagtggatgggctggctcaagccccgcggcggcgccgtcaactacgcccgcgtcttccagggccgcgtcaccatgacccgcgacgtctactccgacaccgccttcctcgagctccgctccctcaccgccgacgacaccgccgtctacttctgcacccgcggcaagaccgtcgactacaactgggacttcgagcacgtcggccccggcacccccgtcaccgtctcctcc

SEQ ID NO: 16960 - RNA, 363 nt, synthetic construct
  misc_feature 1..363: note = derived and/or modified sequence opt2 from anti-HIV_45_HeavyChain
  source 1..363: mol_type = other RNA
caggtccgcctctcccagtccggcggccagatgaagaagcccggcgagtccatgcgcatctcctgccaggcctccggctacgagttcatcgactgcaccctcaactgggtccgcctcgcccccggccgccgccccgagtggatgggctggctcaagccccgcggcggcgccgtcaactacgcccgcatcttccagggccgcgtcaccatgacccgcgacgtctactccgacaccgccttcctcgagctccgctccctcaccgccgacgacaccgccgtctacttctgcacccgcggcaagaactgcgactacaactgggacttcgagcacgtcggccccggctaccccgtcaccgtctccccc

SEQ ID NO: 16961 - RNA, 375 nt, synthetic construct
  misc_feature 1..375: note = derived and/or modified sequence opt2 from anti-HIV_45_HeavyChain
  source 1..375: mol_type = other RNA
caggtccgcctctcccagtccggcggccagatgaagaagcccggcgactccatgcgcatctcctgccgcgcctccggctacgagttcatcaactgccccatcaactggatccgcctcgcccccggcaagcgccccgagtggatgggctggatgaagccccgcggcggcgccgtctcctacgcccgccagctccagggccgcgtcaccatgacccgcgacatgtactccgagaccgccttcctcgagctccgctccctcacctccgacgacaccgccgtctacttctgcacccgcggcaagtactgcaccgcccgcgactactacaactgggacttcgagcactggggccagggcacccccgtcaccgtctcctcc

SEQ ID NO: 16962 - RNA, 435 nt, synthetic construct
  misc_feature 1..435: note = derived and/or modified sequence opt2 from anti-HIV_cap256-206-252885_VR-Chain
  source 1..435: mol_type = other RNA
caggagcagctcgtcgagtccggcggcggcgtcgtcccccccggctcctccctcaccctctcctgcgtcgcctcccgcttcaccttctccgccttcggcatgcactgggtccgccaggcccccggcaagggcctcgagtgggtcgccggcgtctccttcgtcggcatcaagaagtactacgccgactccgtcaagggccgcttcaccatctcccgcgacaactccaagaacaccctcttcctccagatgaacggcctccgcggcgaggacaccggcctctactactgcgtcaaggacatgcgctacctcgagtgcgaggagtgggcctccgactactacgacttcggcaagcccaaccagccctgcctcgaccgccgcggcgtctccggcatctccgccttctggggccagggcaccaccgtcaccgtctcctcc

SEQ ID NO: 16963 - RNA, 438 nt, synthetic construct
  misc_feature 1..438: note = derived and/or modified sequence opt2 from anti-HIV_cap256-206-249183_VR-Chain
  source 1..438: mol_type = other RNA
caggtcctcctcgtcgagtccggcggcggcgtcgtcgagcccggcacctccctcaccctctcctgcgccgcctcccgcttcaccttctccaacttcggcatgcactgggtccgccagacccccggcggcggcctcgagtgggtcgcctccatctccaacgagggcaacaagaagtaccacgccgagtccgtctggggccgcttcatcatctcccgcgacaactccaagaacaccgtcttcctccacatgtcctccctccgccccgacgactccgccctctacttctgcgtccgcgaccgccaggaggacgactgcgaggtctggtggtccgactacgaggccttcggccgcgagatcccctgccgccagtaccgcggccagggcctcgccggcatcttcgacatctggggccgcggcaccatggtcaccgtctcctcc

SEQ ID NO: 16964 - RNA, 438 nt, synthetic construct
  misc_feature 1..438: note = derived and/or modified sequence opt2 from anti-HIV_cap256-206-220956_VR-Chain
  source 1..438: mol_type = other RNA
cagatgatgctcgtcgagtccggcggcgacgtcgtcgagcccggccgctccctcaccctctcctgcgccacctcccagttcaccttctccaactacggcatgcactgggtccgccaggcccccggccgcggcctcgagtgggtcgcctccatctccaacgagggcaacaagaagtaccacgccgagtccgtctggggccgcctcatcatctcccgcgacaactccaagaacaccctcttcctccacatgtcctccctccgcgccgacgactccgccctctacttctgcgtccgcgaccgccaggaggacgagtgcgaggagtggtggtccaactactacgccttcggccgcggcggcccctgccgcaagtaccgcggccagggcctcgccggcatcttcgacgtctggggccgcggcaccatggtcaccgtctcctcc

SEQ ID NO: 16965 - RNA, 432 nt, synthetic construct
  misc_feature 1..432: note = derived and/or modified sequence opt2 from anti-HIV_cap256-206-220629_VR-Chain
  source 1..432: mol_type = other RNA
caggagcagctcgtcgagtccggcggcggcgtcgtcccccccggcaagtccctcaagctctcctgcgtcgcctcccgcttctccttcggcgccttcggcatgcactgggtccgccaggcccccggcaagggcctcgagtgggtcgccggcatctccttcgccggcatcaagaagtactacggcgactccgtcaagggccgcttctacatctcccgcgacaactcccagaacaccctcttcctcgagatgaacggcctccgcggcgacgacaccgcccgctactactgcgtcaaggacctccgcgagctcgagtgcgaggagtgggcctccgactactacgacttcggcaagccccagccctgcctcgactcccgcggcgtctccggcatctccgccatgtggggccccggcaccatggtcaccgtctcctcc

SEQ ID NO: 16966 - RNA, 381 nt, synthetic construct
  misc_feature 1..381: note = derived and/or modified sequence opt2 from anti-HIV_cap256-206-200599_VR-Chain
  source 1..381: mol_type = other RNA
caggagaagctcgtcgagtccggcggcggcgccgtccagcccggcggctccctccgcctctcctgcgtcgcctccggcttcaccttcaacggcttcggcatgcactgggtccgccaggcccccggcaagggcctcgagtgggtcgccaccatctccttctccggcgtctacatctcccgcgagaactccaagaacaccctctacctccagatgaacggcctccgcggcgaggacaccgccctctactactgcgccaaggacctccgctacctcgagtgcggcgagtggtccacctactacccccagccctgcctcgacacccgcggcgtctccggcatctccaacgtctggggccccggcacccgcgtcaccgtctcctcc

SEQ ID NO: 16967 - RNA, 432 nt, synthetic construct
  misc_feature 1..432: note = derived and/or modified sequence opt2 from anti-HIV_cap256-206-186347_VR-Chain
  source 1..432: mol_type = other RNA
caggagctcctcgtcgagtccggcggcggcgtcgtcccccccggcaagtccctcaccatctcctgcgtcgcctcccgcttcaccttctccgccttcggcatgcactgggtccgccaggcccccggcaagggcctccagtgggtcgcctccatctccttcgccggcaccaagaagtactacgccgacttcgtcaagggccgcttcaccatctcccgcgacaactccaagaacaccatcttcctccagatgaacggcctccgcggcgaggacaccgccctctaccactgcgtcaaggacatgcgccagctcgagtgcgaggagtggacctccgactactacgacttcggccgcccccagccctgcatcgaccgccgcggcgtctccggcatctccgccatgtggggccccggcaccatggtcaccgtctcctcc

SEQ ID NO: 16968 - RNA, 438 nt, synthetic construct
  misc_feature 1..438: note = derived and/or modified sequence opt2 from anti-HIV_cap256-206-186226_VR-Chain
  source 1..438: mol_type = other RNA
cagatgctcctcgtcgagtccggcggcggcgtcgtcgagcccggccgctccctcaccctctcctgcgccacctcccagttcaccttctccaactacggcatgcactgggtccgccagacccccggcaccggcctcgagtgggtcgcctccatctccaacgagggcaacaagaagtaccacggcgaggccgtctggggccgcttcatcatctcccgcgacaactccaagaagaccctcttcctccacatgtccaacctccgcgccgacgactccggcctctacttctgcgtccgcgaccgccaggaggacgagtgcgaggagtggtggtccgactactactccttcggccgcggcggcccctgccgcaagtaccacggccagggcctcgccggcatcttcgacatctggggccgcggcaccctcgtcaccgtctcctcc

SEQ ID NO: 16969 - RNA, 435 nt, synthetic construct
  misc_feature 1..435: note = derived and/or modified sequence opt2 from anti-HIV_cap256-206-179686_VR-Chain
  source 1..435: mol_type = other RNA
caggagcagctcgtcgagtccggcggcggcgtcgtccccccctggaagtccctcaccctctcctgcgaggcctcccgcttcaccttctccgccttcggcatgcactgggtccgccaggcccccggcaagggcctcgagtgggtcgccggcatctccttcgccggcatcaagaagtactacgccgactccgtcaagggccgcttcttcatctcccgcgacaactccaagaaccgcgtcctcctcgagatgaacggcctccgccgcgaggacaccgcccgctacttctgcgtcaaggacctccgcgagctcgagtgcgaggagtgggcctccgactactacgacttcggcaagcccaaccagccctgcctcgaccgccgcggcgtctccggcatctccgccatgtggggccagggcaccatggtcaccgtctcctcc

SEQ ID NO: 16970 - RNA, 417 nt, synthetic construct
  misc_feature 1..417: note = derived and/or modified sequence opt2 from anti-HIV_cap256-206-173707_VR-Chain
  source 1..417: mol_type = other RNA
caggagaagctcgtcgagtccggcggcggcgccgtccagcccggcggctccctccgcctctcctgcgtcgcctccggcttcaccttcaagggcttcggcatgcactgggtccgccaggcccccggcaagggcctcgagtgggtcgccaccatctccttctccggcgtcaagaagtactacggcaactccgccaagggccgcttcttcatctcccgcgacaacctcaagaacaccgtctacctcgagatgaacggcctccgcggcgaggacaccgccctctactactgcgccaaggacctccgctacctcgagtgcggcgagtggtccacctactacccccagccctgcctcgacacccgcggcgtctccggcatctccaacgtctggggccccggcaccaaggtcaccgtctcctcc

SEQ ID NO: 16971 - RNA, 432 nt, synthetic construct
  misc_feature 1..432: note = derived and/or modified sequence opt2 from anti-HIV_cap256-206-173339_VR-Chain
  source 1..432: mol_type = other RNA
caggagctcctcgtcgagtccggcggcggcgtcgtcccccccggcaagtccctcaagctctcctgcgtcgcctcccgcttcaccttcggcgccttcggcatgcactgggtccgccaggcccccggcaagggcctcgagtgggtcgccggcatctccttcgccggcaccaagaactactacgccgactccgtcaagggccgcttcaccatctcccgcgacaaccccaagaacaccctcttcctccagatgaacggcctccgcggcgacgacaccggcctctactactgcgtcaaggacatgcgcgagctcgagtgcgagctctggacctccgactactacgacttcggccgcccccagccctgcatcgaccagcgcggcgtctccggcatctccgccatgtggggccagggcaccatggtcaccatctcctcc

SEQ ID NO: 16972 - RNA, 438 nt, synthetic construct
  misc_feature 1..438: note = derived and/or modified sequence opt2 from anti-HIV_cap256-206-172689_VR-Chain
  source 1..438: mol_type = other RNA
cagatgatgctcgtcgagtccggcggcggcgtcgtcgagcccggccgctccctcaccctctcctgcgccacctcccacttcaccttctccaactacggcatgcactgggtccgccaggcccccggcggccgcctcgagtgggtcgcctccatctccaacgccggcaacaagaagtaccacggcgactccgtctggggccgcctcatcatctcccgcgacaactccaagaacaccctcttcctccacatgtcctccctccgcgtcgacgactccgccctctacttctgcgtccgcgaccgccaggaggacgagtgcgaggagtggtggtccgactactacgccttcggccgcggcggcccctgccgcaagtaccgcggccagggcctcgccggcatcttcgacatctggggccgcggcaccatggtcaccgtctcctcc

SEQ ID NO: 16973 - RNA, 432 nt, synthetic construct
  misc_feature 1..432: note = derived and/or modified sequence opt2 from anti-HIV_cap256-206-162744_VR-Chain
  source 1..432: mol_type = other RNA
caggagaagctcgtcgagtccggcggcggcgtcgtcccccccggcaagtccctccgcctctcctgcgtcgcctccggcttcaccttctccgccttcggcatgcactgggtccgccaggcccccggcaagggcctcgagtgggtcgccggcatctccttcgccggcatcaagaactactacgccgactccgtcaagggccgcttcaccatctcccgcgacaactccaagaactccctcttcctccagatgaacggcctccgcggcgacgacaccgcccgctactactgcgtcaaggacatgcgcgagctcgagtgcgaggagtggacctccgactactacgacttcggcaagccccagccctgcatcgaccgccgcggcgtctccggcatctccgccatgtggggccagggcaccatggtcaccatctcctcc

SEQ ID NO: 16974 - RNA, 438 nt, synthetic construct
  misc_feature 1..438: note = derived and/or modified sequence opt2 from anti-HIV_cap256-206-146057_VR-Chain
  source 1..438: mol_type = other RNA
cagatgcagctcgtcgagtccggcggcggcgtcgtccagcccggcacctccctcaccctctcctgcgtcgcctcccagttcaccttctccaactacggcatgcactggatccgccaggcccccggccagggcctcgagtgggtcgcctccatctccaacgacggcggcaagcgctaccacggcgacgccgtctgggcccgcttcatcatctcccgcgacaactccaagaacaccgtcttcctccagatgacctccctccgcgccgaggacaccgcccgctacttctgcgtccgcgaccgccaggaggacgagtgcctcgagtggtggtccgactactacaacttcggccgccagctcccctgcgccaagttccgcggcctcggcctcgccggcgtcttcgacatctggggccacggcaccatggtcaccgtctcctcc

SEQ ID NO: 16975 - RNA, 435 nt, synthetic construct
  misc_feature 1..435: note = derived and/or modified sequence opt2 from anti-HIV_cap256-206-139519_VR-Chain
  source 1..435: mol_type = other RNA
caggagcagctcgtcgagtccggcggcggcgtcgtcccccccggcacctccctccgcctctcctgcgtcgcctcccgcttctccttcggctccttcggcatgcactgggtccgccaggcccccggcaagggcctcgagtgggtcgccggcatctccttcgtcggcatcaagaagtactacggcgactccgtcaagggccgcttcttcatctcccgcgacaactccaagaacaccctcttcctcgagatgaacggcctccgcggcgaggacaccgcccgctactactgcgtcaaggacatgcgcgagctcgagtgcgaggagtgggcctccgactactacgacttcggcaagcccaaccagccctgcctcgaccgccgcggcgtctccggcatctccgccatgtggggccccggcaccatgctcaccgtctcctcc

SEQ ID NO: 16976 - RNA, 432 nt, synthetic construct
  misc_feature 1..432: note = derived and/or modified sequence opt2 from anti-HIV_cap256-206-136316_VR-Chain
  source 1..432: mol_type = other RNA
caggagcagctcgtcgagtccggcggcggcgtcgtcccccccggcaagtccctcaccctctcctgcgtcgcctccggcttcaccttctccgccttcggcatgcactgggtccgccaggcccccggcaagggcctcgagtgggtcgccggcatctccttcgtcggcatcaagaagtactacggcgactccgtcaagggccgcttcaccatctcccgcgacaactccaagaacaccctcttcctccagatgaacggcctccgcggcgacgacaccgccctctaccactgcgtcaaggacatgcgccagctcgagtgcgaggagtggacctccgactactacgacttcggcaagccccagccctgcatcgacccccgcggcgtctccggcatctccgccatgtggggccagggcaccatggtcaccgtctcctcc

SEQ ID NO: 16977 - RNA, 438 nt, synthetic construct
  misc_feature 1..438: note = derived and/or modified sequence opt2 from anti-HIV_cap256-206-116098_VR-Chain
  source 1..438: mol_type = other RNA
cagatgatgctcgtcgagtccggcggcggcgtcgtcgagcccggccgctccctcaccctctcctgcgccgcctcccagttcaccttctccaactacggcatgcactgggtccgccaggcccccggccgcgagctcgagtgggtcgcctccatctccaacgccggcaacaagaagtaccacggcgaggccgtctggggccgcctcatcatctcccgcgacaactccaagaacaccctcttcctccacatgtccaacctccgccccgacgactccgccctctacttctgcgtccgcgaccgccaggaggacgagtgcgaggagtggtggtccgactactacgccttcggccgcggcggcccctgccgcaagtaccacggccagggcctcgccggcatcttcgacatctggggccgcggcaccatggtcaccgtctcctcc

SEQ ID NO: 16978 - RNA, 432 nt, synthetic construct
  misc_feature 1..432: note = derived and/or modified sequence opt2 from anti-HIV_cap256-206-115862_VR-Chain
  source 1..432: mol_type = other RNA
caggagcagctcgtcgagtccggcggcggcgtcgtcccccccggcaagtccctccgcctctcctgcgtcggctcccgcttcaccttctccgccttcggcatgcactgggtccgccaggcccccggcaagggcctcgagtgggtcgcctccatctccttcgccggcaccaagaagtactacgtcgactccgtcaagggccgcttcttcatctcccgcgacaactccaagaacaccgtcttcctcgagatgaacggcctccgcggcgaggacaccggcctctactactgcgtcaaggacatgcgcgagctcgagtgcgaggagtgggcctccgactactacgacttcggcaagccccagccctgcctcgaccgccgcggcgtctccggcatctccgccatgtggggccagggcaccctcgtcatcatctcctcc

SEQ ID NO: 16979 - RNA, 435 nt, synthetic construct
  misc_feature 1..435: note = derived and/or modified sequence opt2 from anti-HIV_cap256-206-107018_VR-Chain
  source 1..435: mol_type = other RNA
caggagcagctcgtcgagtccggcggcggcgtcgtcccccccggcaagtccctcaccctctcctgcgtcgcctcccgcttctccttctccgccttcggcatgcactgggtccgccaggcccccggcaagggcctcgagtgggtcgcctccatctccttcgtcggcatcaagaagtactacggcgactccgtcaagggccgcttcttcatctcccgcgacaactccaagaacaccgtcttcctcgagatgaacggcctccgcggcgaggacaccggcctctactactgcgtcaaggacatgcgcgagctcgagtgcgaggagtgggcctccgactactacgacttcggcaagcccaaccagccctgcctcgaccgccgcggcgtctccggcatctccgccatgtggggccagggcaccctcgtcatcgtctcctcc

SEQ ID NO: 16980 - RNA, 438 nt, synthetic construct
  misc_feature 1..438: note = derived and/or modified sequence opt2 from anti-HIV_cap256-206-098644_VR-Chain
  source 1..438: mol_type = other RNA
cagatgctcctcgtcgagtccggcggcggcgtcgtcgagcccggccgctccctcaccctctcctgcgccgcctcccagttcaccttctccaactacggcatgcactgggtccgccaggcccccggcggcggcctcgagtgggtcgcctccatctccaacgagggcaacaagcgctaccacggcgagtccgtctggggccgcttcgtcatctcccgcgacaactccaagaacaccctcttcctccacatgtccaccctccgccccgacgactccgccctctacttctgcgtccgcgaccgccaggaggacgagtgcgaggagtggtggtccgactactacgccttcggccgcggcggcccctgccgcaagtaccacggccagggcctcgccggcatcttcgacgtctggggccgcggcaccatggtcaccggcctcttc

SEQ ID NO: 16981 - RNA, 417 nt, synthetic construct
  misc_feature 1..417: note = derived and/or modified sequence opt2 from anti-HIV_cap256-206-098135_VR-Chain
  source 1..417: mol_type = other RNA
caggagaagctcgtcgagtccggcggcggcgccgtccagcccggcggctccctccgcctctcctgcgtcgcctccggcttcaccttctccggcttcggcatgcactgggtccgccaggcccccggcaagggcctcgagtgggtcgccaccatctccttctccggcatgaagaagtactacggcacctccgccaagggccgcttctccatctaccgcgacaactccaagaacaccctctacctccagatggacggcctccgcgagaaggacaccgccctctactactgcgccaaggacctccgctacctcgagtgcggcgagtggtccacctactacccccagccctgcctcgaccgccgcggcgtctccggcatctccaacgtctggggccccggcaccatggtcaccgtctcctcc

SEQ ID NO: 16982 - RNA, 435 nt, synthetic construct
  misc_feature 1..435: note = derived and/or modified sequence opt2 from anti-HIV_cap256-206-096276_VR-Chain
  source 1..435: mol_type = other RNA
caggagcagctcgtcgagtccggcggcggcgtcgtcccccccggctcctccctccgcctctcctgcgtcgcctcccgcttcaccttctccgccttcggcatgcactgggtccgccaggcccccggcaagggcctcgagtgggtcgccggcatctccttcgtcggcatcaagaagtactacgccgactccgtcaagggccgcttcaccatctcccgcgacaactccaagaacaccctcttcctccagatgaacggcctccgcggcgaggacaccggcctctactactgcgtcaaggacatgcgcgagctcgagtgcgaggagtggcgctccgactactacgacttcggcaagcccaaccagccctacctcgaccgccgcggcgtctccggcatctccgccttctggggccagggcaccatggtcaccgtctcctcc

SEQ ID NO: 16983 - RNA, 438 nt, synthetic construct
  misc_feature 1..438: note = derived and/or modified sequence opt2 from anti-HIV_cap256-206-092794_VR-Chain
  source 1..438: mol_type = other RNA
cagatgatgctcgtcgagtccggcggcggcgtcgtcgagcccggccgctccctcaccctctcctgcgccacctcccagttcaccttctccaactacggcatgcactgggtccgccaggcccccggccgcggcctcgagtgggtcgcctccatctccaacgagggcaacaagcgctaccacggcgagtccgtctggggccgcttcatcatctcccgcgacaactccaagaacaccctcttcctccacatgtccaccctccgcgccgacgactccgccctctacttctgcgtccgcgaccgccaggaggacgagtgcgaggagtggtggtccgactactacgccttcggccgcggcggcccctgccgcaagtaccacggccagggcctcgccggcatcttcgacatcgtcggccgcggcaccctcgtcaccgtctcctcc

SEQ ID NO: 16984 - RNA, 432 nt, synthetic construct
  misc_feature 1..432: note = derived and/or modified sequence opt2 from anti-HIV_cap256-206-086817_VR-Chain
  source 1..432: mol_type = other RNA
caggagcagctcgtcgagtccggcggcggcgtcgtcccccccggcaagtccctccgcctctcctgcgccgcctccggcttctccttcggcgccttcggcatgcactgggtccgccaggcccccggcaagggcctcgagtgggtcgccggcatctccttcgtcggcatcaagtactactacgccgactccgtcaagggccgcttcaccatctcccgcgacaactccaagaacaccgtcttcctccagatgaacggcctccgcggcgacgacaccggccgctactactgcgtcaaggacatgcgcgagctcgagtgcgaggagtggacctccgactactacgacttcggcaagccccagccctgcatcgaccgccgcggcgtctccggcatctccgccatgtggggccagggcaccatggtcaccatctcctcc

SEQ ID NO: 16985 - RNA, 432 nt, synthetic construct
  misc_feature 1..432: note = derived and/or modified sequence opt2 from anti-HIV_cap256-206-086446_VR-Chain
  source 1..432: mol_type = other RNA
caggagcagctcgtcgagtccggcggcggcgtcgtcccccccggcaagtccctccgcctctcctgcgtcgcctcccgcttcaccttctccgccttcggcatgcactgggtccgccaggcccccggcaagggcctcgagtgggtcgccggcatctccttcgtcggcatcaagaagtactactccgacgccgtcaagggccgcttctacatctcccgcgacaactccaagaacaccctcttcctcgagatgaacggcctccgcggcgacgacaccgcccgctactactgcgtcaaggacctccgcgagctcgagtgcgaggagtgggcctccgactactacgacttcggcaagccccagccctgcctcgactcccgcggcgtctccggcatctccgccatgtggggccagggcaccatggtcaccgtctcctcc

SEQ ID NO: 16986 - RNA, 432 nt, synthetic construct
  misc_feature 1..432: note = derived and/or modified sequence opt2 from anti-HIV_cap256-206-086180_VR-Chain
  source 1..432: mol_type = other RNA
caggagcagctcgaggagtccggcggcggcgtcgtcccccccggcaagtccctccgcctctcctgcgtcgcctcccgcttcaccttctccgccttcggcatgcactgggtccgccaggcccccggcaagggcctcgagtgggtcgccggcatctccttcgtcggcatcaagaagtactacgccgactccgtcaagggccgcttcaccatctcccgcgacaactccaagaacaccctcttcctccagatgaacggcctccgcggcgacgacaccggcctctacttctgcgtcaaggacatgcgcgagctcgagtgcgagcagtggacctccgactactacgacttcggcaagccccagccctgcatcgacccccgcggcgtctccggcatctccgccatgtggggccagggcaccatggtcaccgtctcctcc

SEQ ID NO: 16987 - RNA, 435 nt, synthetic construct
  misc_feature 1..435: note = derived and/or modified sequence opt2 from anti-HIV_cap256-206-083708_VR-Chain
  source 1..435: mol_type = other RNA
caggagcagctcgtcgagtccggcggcggcgtcatcccccccggccagtccctccgcctctcctgcgtcgcctcccgcttcaccttctccgccttcggcatgcactgggtccgccaggcccccggcaagggcctcgagtgggtctcctccgtctccttcgccggcatcaagaagtactacgccgactccgtcaagggccgcttcttcatctcccgcgacaactccaagaacaccgtcttcctcgagatgaacggcctccgcggcgaggacaccggcctctactactgcgtcaaggacatgcgcgagctcgagtgcgaggagtgggcctccgactactacgacttcggcaagcccgaccagccctgcctcgaccgccgcggcgtctccggcatctccgccatgtggggccagggcaccctcgtcatcgtctcctcc

SEQ ID NO: 16988 - RNA, 432 nt, synthetic construct
  misc_feature 1..432: note = derived and/or modified sequence opt2 from anti-HIV_cap256-206-079556_VR-Chain
  source 1..432: mol_type = other RNA
caggagcagctcgtcgagtccggcggcggcgtcgtcccccccggcaagtccctccgcctctcctgcgtcgcctccggcttcaccttctccggcttcggcatgcactgggtccgccaggcccccggcaagggcctcgagtgggtcgccggcatctccttcgtcggcatcaagtactactacgccgactccgtcaagggccgcttctccatctcccgcgacaactccaagaacaccctcttcctccagatgaacggcctccgcggcgacgacaccgccctctactactgcgtcaaggacatgcgcgagctcgagtgcgaggagtggacctccgactactacgacttcggcaagccccagccctgcatcgaccgccgcggcgtctccggcatctccgccatgtggggccagggcaccatggtcaccgtctcctcc

SEQ ID NO: 16989 - RNA, 438 nt, synthetic construct
  misc_feature 1..438: note = derived and/or modified sequence opt2 from anti-HIV_cap256-206-078657_VR-Chain
  source 1..438: mol_type = other RNA
cagatgctcctcgtcgagtccggcggcggcgtcgtcgagcccggccgctccctcaccctctcctgcgccacctcccagttcaccttctccaactacggcatgcactgggtccgccaggcccccggccgcggcctcgagtgggtcgcctccatctccaacgagggctccaagaagtaccacggcgagcccgtctggggccgcttcatcatctcccgcgacaactccaagaagaccctcttcctccacatgtccaacctccgcgtcgacgactccgccctctacttctgcgtccgcgaccgccaggaggacgagtgcgaggagtggtggtccgactactacgccttcggccgcggcggcccctgccgcaagtaccacggccagggcctcgccggcatcttcgacatctggggccgcggcaccatggtcaccgtctcctcc

SEQ ID NO: 16990 - RNA, 438 nt, synthetic construct
  misc_feature 1..438: note = derived and/or modified sequence opt2 from anti-HIV_cap256-206-075802_VR-Chain
  source 1..438: mol_type = other RNA
cagatgctcctcgtcgagtccggcggcgacgtcgtcgagcccggcaagtccctcaccctctcctgcgccacctcccgcttcaccttctccaactacggcatgcactgggtccgccaggcccccggcggcggcctcgagtgggtcgcctccatctccaacgagggcaacaagaagtaccacggcgagtccgtctggggccgcttcatcatctcccgcgacaactccaagaacaccctcttcctccacatgtccgccctccgcaccgacgactccgccctctacttctgcgtccgcgaccgccaggaggacgagtgcgaggagtggtggtccgactactacgccttcggccgcggcggcccctgccgcaagtaccacggccagggcctcgccggcatcttcgacatctggggccgcggcaccatggtcaccgtctcctcc

SEQ ID NO: 16991 - RNA, 438 nt, synthetic construct
  misc_feature 1..438: note = derived and/or modified sequence opt2 from anti-HIV_cap256-206-069097_VR-Chain
  source 1..438: mol_type = other RNA
cagatgctcctcgtcgagtccggcggcggcgtcgtcgagcccggccgctccctcaccctctcctgcgccacctcccgcttcaccttctccaactacggcatgcactgggtccgccaggcccccggccgcgagctcgagtgggtcgcctccatctccaacgagggcaacaagaagtaccacgccgagtccgtctggggccgcttcatcatctcccgcgacaactccaagaacaccctcttcctccacatgtccaacgtccgcggcgacgactccgccctctacttctgcgtccgcgaccgccaggaggacgagtgcgaggagtggtggtccgactactacgccttcggccgcggcggcccctgccgcaagtaccacggccagggcctcgccggcatcttcgacgtctggggccgcggcaccgtcgtcaccgtctcctcc

SEQ ID NO: 16992 - RNA, 438 nt, synthetic construct
  misc_feature 1..438: note = derived and/or modified sequence opt2 from anti-HIV_cap256-206-067758_VR-Chain
  source 1..438: mol_type = other RNA
cagatgctcctcgtcgagtccggcggcggcgtcgtcgagcccggccgctccctcaccctctcctgcgccgcctcccagttcaccttctcccactacggcatgcactgggtccgccaggcccccggccgcggcctcgagtgggtcgcctccatctccaacgagggcaacaagcgctaccacggcgagtccgtctggggccgcttcatcatctcccgcgacaactccaagaacaccctcttcctccacatgtccgccctccgcaccgacgactccgccctctacttctgcgtccgcgaccgccaggaggacgagtgcgaggagtggtggtccgactactacgccttcggccgcggcggcccctgccgcaagtggcacggccagggcctcgccggcatcttcgacatctggggccgcggcaccgtcgtcaccgtctcctcc

SEQ ID NO: 16993 - RNA, 417 nt, synthetic construct
  misc_feature 1..417: note = derived and/or modified sequence opt2 from anti-HIV_cap256-206-057019_VR-Chain
  source 1..417: mol_type = other RNA
caggagaagctcgtcgagtccggcggcggcgccgtccagcccggcggctccctccgcctctcctgcgtcgcctccggcttctccttctccggctacggcatgcactgggtccgccaggcccccggcaagggcctcgagtggctcgccaccatctccttctccggcgtcaagaagtactacggcacctccgccaagggccgcttctacatctaccgcgacaacaccaagaacaccatgtacctcgagatgaacggcctccgcggcgaggacaccgccctctactactgcgccaaggacctccgctacctcgagtgcggcgagtggtccacctactacccccagccctgcctcgacacccgcggcgtctccggcatctccaacgtctggggccccggcaccatggtcaccgtctcctcc

SEQ ID NO: 16994 - RNA, 438 nt, synthetic construct
  misc_feature 1..438: note = derived and/or modified sequence opt2 from anti-HIV_cap256-206-055385_VR-Chain
  source 1..438: mol_type = other RNA
cagatgatgctcgtcgagtccggcggcggcgtcgtcgagcccggccgctccctcaccctctcctgcgccgcctccaagttcaccttctccaactacggcatgcactgggtccgccaggcccccggccgcggcctcgagtgggtcgcctccatctccaacgagggcaacaagaagtaccacggcgagcccgtctggggccgcctcatcatctcccgcgacaactccaagaacaccctcttcctccacatgtccgacctccgcgccgacgactccgccctctacttctgcgtccgcgaccgccaggaggacgagtgcgaggagtggtggtccaactactacgccttcggccgcggcggcccctgccgcaagtggcgcggccagggcctcgccggcatcttcgacgtctggggccgcggcaccatggtcaccgtctcctcc

SEQ ID NO: 16995 - RNA, 435 nt, synthetic construct
  misc_feature 1..435: note = derived and/or modified sequence opt2 from anti-HIV_cap256-206-053187_VR-Chain
  source 1..435: mol_type = other RNA
caggagcagctcgtcgagtccggcggcggcgtcgtcccccccggctcctccctccgcctctcctgcgtcgcctcccgcttcaccttctccgccttcggcatgcactgggtccgccaggcccccggcaagggcctcgagtgggtcgccggcatctccttcgtcggcatcaagtactactacgccgactccgtcaagggccgcttcaccatctcccgcgacaactccaagaacaccctcttcctccagatgaacggcctccgcggcgaggacaccggcctctactactgcgtcaaggacatgcgcgagctcgagtgcgaggagtgggcctccgactactacgacttcggcaagcccaaccagccctgcctcgaccgccgcggcgtctccggcatctccgccttctggggccagggcaccatggtcaccgtctcctcc

SEQ ID NO: 16996 - RNA, 438 nt, synthetic construct
  misc_feature 1..438: note = derived and/or modified sequence opt2 from anti-HIV_cap256-206-053139_VR-Chain
  source 1..438: mol_type = other RNA
cagatgctcctcgtcgagtccggcggcgacgtcgtcgagcccggccgctccctcaccctctcctgcgccacctcccagttcaccttctccaactacggcatgcactgggtccgccaggcccccggccgcggcctcgagtgggtcgcctccatctccaacgagggctccaagaagtaccacggcgagtccgtctggggccgcttcatcatctcccgcgacaactccaagaacaccctcttcctccacatgaccaccctccgccccgacgactccgccctctacttctgcgtccgcgaccgccaggaggacgagtgcgaggagtggtggtccgactactacgccttcggccgcggcggcccctgccgcaagtaccacggccagggcctcgccggcatcttcgacatctggggccgcggcaccatggtcaccgtctcctcc

SEQ ID NO: 16997 - RNA, 432 nt, synthetic construct
  misc_feature 1..432: note = derived and/or modified sequence opt2 from anti-HIV_cap256-206-050350_VR-Chain
  source 1..432: mol_type = other RNA
caggagcagctcgtcgagtccggcggcggcgtcgtcccccccggcaagtccctcaagctctcctgcgtcgcctcccgcttctccttcggcgccttcggcatgcactgggtccgccaggcccccggcaagggcctcgagtgggtcgccggcatctccttcgtcggcatcaagaagtactacgccgactccgtcaagggccgcttctacatctcccgcgacaactccaagaacaccgtcttcctcgagatgaacgccctccgcggcgaggacaccgccctctaccactgcgtcaaggacatgcgcgagctcgagtgcgaggagtgggcctccgactactacgacttcggcaagccccagccctgcctcgaccgccgcggcgtctccggcatctccgccatgtggggccccggcaccatggtcatcgtctcctcc

SEQ ID NO: 16998 - RNA, 432 nt, synthetic construct
  misc_feature 1..432: note = derived and/or modified sequence opt2 from anti-HIV_cap256-206-046207_VR-Chain
  source 1..432: mol_type = other RNA
caggagcagctcgtcgagtccggcggcggcgtcgtcccccccggcacctccctccgcctctcctgcgtcgcctcccgcttcaccttctccgccttcggcatgcactgggtccgccaggcccccggcaagggcctcgagtgggtcgccggcatctccttcgccggcatcaagaagtactacgccgactccgtcaagggccgcttcaccatctcccgcgacaactccaagaactccctcttcctcgagatgaacggcctccgcggcgacgacaccgccctctactactgcgtcaaggacctccgctacctcgagtgcgagctctggacctccgactactacgacttcggccgcccccagccctgcatcgactcccgcggcgtctccggcatctccgccatgtggggccccggcaccatggtcaccgtctccgcc

SEQ ID NO: 16999 - RNA, 417 nt, synthetic construct
  misc_feature 1..417: note = derived and/or modified sequence opt2 from anti-HIV_cap256-206-043389_VR-Chain
  source 1..417: mol_type = other RNA
caggagaagctcgtcgagtccggcggcggcgccgtccagcccggcggctccctccgcctctcctgcgtcgcctccggcttcaccttctccggcttcggcatgcactggttccgccaggcccccggcaagggcctcgagtgggtcgccaccatctccttctccggcatcaagaagtactacaacacctccgccaagggccgcttcttcatctcccgcgacaacaccaaggacaccctctacctccagatggacggcctccaggagaaggacaccgccctctacctctgcgccaaggacctccgctacctcgagtgcggctactggtccacctactacccccagccctgcctcgacacccgcggcgtctccggcatctccaacgtctggggccccggcaccatggtcaccgtctcctcc

SEQ ID NO: 17000 - RNA, 432 nt, synthetic construct
  misc_feature 1..432: note = derived and/or modified sequence opt2 from anti-HIV_cap256-206-042555_VR-Chain
  source 1..432: mol_type = other RNA
caggagcagctcgtcgagtccggcggcggcgtcgtcccccccggcaagtccctccgcctctcctgcgtcgtctccggcttcaccttctccgccttcggcatgcactgggtccgccaggcccccggcaagggcctcgagtgggtcgccggcatctccttcgccggcaccaagtcctactacgccgagtccgtcaagggccgcttcaccatctcccgcgacaactccaagaactccctcttcctccagatgaacggcctccgcggcgacgacaccgccctctactactgcgtcaaggacatgcgcgagctcgagtgcgagctctggacctccgactactacgacttcggccgcccccagccctgcatcgaccgccgcggcgtctccggcatctccgccatgtggggccagggcaccatggtcaccatctcctcc

SEQ ID NO: 17001 - RNA, 432 nt, synthetic construct
  misc_feature 1..432: note = derived and/or modified sequence opt2 from anti-HIV_cap256-206-029720_VR-Chain
  source 1..432: mol_type = other RNA
caggagaagctcgtcgagtccggcggcggcgtcgtccagcccggccgctccctcaccctctcctgcgtcgcctcccacttcaccttctccggcgtcggcatgcactgggtccgccaggcccccggcaagggcctcgagtgggtcgccggcatctccttcgccggcacccgcaagtactacgccgactccgtcaagggccgcttcaccatctcccgcgacaactccaagaacaccgtctacctccagatgaacggcctccgcggcgaggacaccgccctctaccactgcgccaaggacctccgcgagctcgagtgcgagctctggacctccgactactacgacttcggccgcccccagccctgcatcgaccgccgcggcgtctccggcatctgcgacatgtggggccagggcaccatggtcatcgtctcctcc

SEQ ID NO: 17002 - RNA, 432 nt, synthetic construct
  misc_feature 1..432: note = derived and/or modified sequence opt2 from anti-HIV_cap256-206-028848_VR-Chain
  source 1..432: mol_type = other RNA
caggagcagctcgtcgagtccggcggcggcgtcgtcccccccggcaagtccctccgcctctcctgcgtcgcctccggcttcaccttctccggcttcggcatgcactgggtccgccaggcccccggcaagggcctccagtgggtcgccggcatctccttcgccggcaccaagtactactacgaggactccgtcaagggccgcttcaccatctcccgcgacaactccaagaacaccgtcttcctccagatgaacggcctccgcggcgacgacaccgccctctactactgcgtcaaggacatgcgcgagctcgagtgcgaggagtggacctccgactactacgacttcggcaagccccagccctgcatcgaccgccgcggcgtctccggcatctccgccatgtggggccagggcaccatggtcaccatctcctcc

SEQ ID NO: 17003 - RNA, 432 nt, synthetic construct
  misc_feature 1..432: note = derived and/or modified sequence opt2 from anti-HIV_cap256-206-027652_VR-Chain
  source 1..432: mol_type = other RNA
caggagcagctcgtcgtctccggcggcgacgtcgtcccccccggcaagtccctccgcctctcctgcgtcgcctccggcttcaccttctccgccttcggcatgcactgggtccgccaggcccccggcaagggcctcgagtgggtcgcctccatctccttcgccggcaccaagtactactacgccgactccgtcaagggccgcttcgccatctcccgcgacaactccaagaacaccctcttcctccagatgaacggcctccgccgcgaggacaccggcctctactactgcgtcaaggacatgcgccagctcgagtgcgaggagtggacctccgactactacgacttcggccgcccccagccctgcatcgaccgccgcggcgtctccggcatctccgccatgtggggccagggcaccatggtcaccatctcctcc

SEQ ID NO: 17004 - RNA, 417 nt, synthetic construct
  misc_feature 1..417: note = derived and/or modified sequence opt2 from anti-HIV_cap256-206-024075_VR-Chain
  source 1..417: mol_type = other RNA
caggagaagctcgtcgagtccggcggcggcgccgtccagcccggcggctccctccgcctctcctgcgtcgcctccggcttcaccttctccggcttcggcatgcactgggtccgccaggcccccggcaagggcctcgagtggctcgccaccatctccttctccggcgtcaagaagtactacggcacctccgccaagggccgcttctacatctcccgcgacaacaccaagaacaccgtctacctccagatggacggcctccgcggcgacgacaccgccatctactactgcgccaaggacctccgcttcctcgagtgcggcctctggtccacctactacccccagccctgcctcgacacccgcggcgtctccggcatctccaacgtctggggccccggcaccatggtcaccgtctcctcc

SEQ ID NO: 17005 - RNA, 417 nt, synthetic construct
  misc_feature 1..417: note = derived and/or modified sequence opt2 from anti-HIV_cap256-206-008748_VR-Chain
  source 1..417: mol_type = other RNA
caggagaagctcgtcgagtccggcggcggcgccgtccagcccggcggctccctccgcctctcctgcgtcgcctccggcttcaccttcaacggcttcggcatgcactgggtccgccaggcccccggcaagggcctcgagtgggtcgccaccatctccttctccggcgtcaagaagtactacggcacctccgccaagggccgcttcttcatctcccgcgagaactccaagaacaccctctacctccagatgaacggcctccgcggcgaggacaccgccctctactactgcgccaaggacctccgctacctcgagtgcggcgagtggtccacctactacccccagccctgcctcgacacccgcggcgtctccggcatctccaacgtctggggccccggcacccgcgtcaccgtctcctcc

SEQ ID NO: 17006 - RNA, 432 nt, synthetic construct
  misc_feature 1..432: note = derived and/or modified sequence opt2 from anti-HIV_cap256-206-008530_VR-Chain
  source 1..432: mol_type = other RNA
caggagcagctcgtcgagtccggcggcggcgtcgtcccccccggcaagtccctccgcctctcctgcgtcgcctccggcttctccttcggcgccttcggcatgcactgggtccgccaggcccccggcaagggcctcgagtgggtcgccggcatctccttcgtcggcatcaagtactactacgccgactccgtcaagggccgcttcaccatctcccgcgacaactccaagaagaccctcttcctccagatgaacggcctccgcggcgacgacaccgccctctactactgcgtcaaggacatgcgcgagctcgagtgcgaggagtggacctccgactactacgacttcggcaagccccagccctgcatcgaccgccgcggcgtctccggcatctccgccttctggggccagggcaccatggtcaccatctcctcc

SEQ ID NO: 17007 - RNA, 432 nt, synthetic construct
  misc_feature 1..432: note = derived and/or modified sequence opt2 from anti-HIV_cap256-176-723043_VR-Chain
  source 1..432: mol_type = other RNA
caggagcagctcgtcgagtccggcggcggcgtcgtcccccccggcaagtccctccgcctctcctgcgtcgcctccggcttcaccttctccgccttcggcatgcactgggtccgccaggcccccggcaagggcctcgagtgggtcgccggcgtctccttcgccggcatcaagtactactacgccgactccgtcaagggccgcttcaccatctcccgcgacaactccaagaacaccctcttcctccagatgaacggcctccgcggcgacgacaccgccctctactactgcgtcaaggacctccgcgagctcgagtgcgaggagtggacctccgactactacgacttcggccgcccccagccctgcatcgacccccgcggcgtctccggcatctccgccatgtggggccagggcaccgtcgtcaccatctcctcc

SEQ ID NO: 17008 - RNA, 432 nt, synthetic construct
  misc_feature 1..432: note = derived and/or modified sequence opt2 from anti-HIV_cap256-176-600049_VR-Chain
  source 1..432: mol_type = other RNA
gaggtccagctcgtccagtccggcggcggcgtcgtccagcccggccgctccctccgcctctcctgcgccgccccctacttcgagttcggccgctacggcttccactgggtccgccaggcccccggcaagggcctcgagtgggtcgcctccatctccttcgccggccgcggctactaccactccccctccgtctggggccgcttcaccatctcccgcgacaactccaagaacaccctctacctccagatgaactccctccgcatcgaggacaccgccctctacttctgcgcccgcgacctccgcgagtccgagtgcgaggagtgggagtccgactactacgacttcggcaagaagggcccctgcgtcaagccccgcggcgtcgccggcggcctcgacctctggggccagggcaccatggtcatcgtctcctcc

SEQ ID NO: 17009 - RNA, 432 nt, synthetic construct
  misc_feature 1..432: note = derived and/or modified sequence opt2 from anti-HIV_cap256-176-531926_VR-Chain
  source 1..432: mol_type = other RNA
caggtccagctcgtcgagtccggcggcggcgtcgtcccccccggcaagtccctcaccctctcctgcgtcgcctcccgcttcaccttctccgccttcggcatgcactgggtccgccaggcccccggcaagggcctcgagtgggtcgccggcatctccttcgtcggcatccgcaagtactacgccgactccgtcaagggccgcttctccatctcccgcgacaactccaagaacaccgtcttcctcgagatgaacggcctccgcggcgaggacaccggcctctactactgcgtcaaggacatgcgcgagctcgagtgcgaggagtgggcctccgactactacgacttcggcaagccccagccctgcctcgaccgccgcggcgtctccggcatctccgccatgtggggccagggcaccctcgtcatcatctcctcc

SEQ ID NO: 17010 - RNA, 432 nt, synthetic construct
  misc_feature 1..432: note = derived and/or modified sequence opt2 from anti-HIV_cap256-176-504134_VR-Chain
  source 1..432: mol_type = other RNA
gaggtccagctcgtcgagtccggcggcggcgtcgtcccccccggcaagtccctccgcctctcctgcgtcacctcccgcctcgccttcggcgccttcggcatgcactgggtccgccaggcccccggcaagggcctcgagtgggtcgcctccatctccttcgccggcatcaagaagtactacgccgactccgtcaagggccgcttcaccatctcccgcgacaactccaaggacaccgtcttcctcgagatgaacggcctccgcggcgacgacaccggcctctactactgcgtcaaggacatgcgctacctcgagtgcgaggagtgggcctccgactactacgacttcggccgcccccagccctgcctcgacccccgcggcgtctccggcatctccgccatgtggggccagggcaccctcgtcatcatctcctcc

SEQ ID NO: 17011 - RNA, 432 nt, synthetic construct
  misc_feature 1..432: note = derived and/or modified sequence opt2 from anti-HIV_cap256-119-186229_VR-Chain
  source 1..432: mol_type = other RNA
cagatgcagctcgtcgagtccggcggcggcgtcgtccagcccggcggctccctccgcctcctctgctccgcctccggcttcaccttctccacctacggcatgcactgggtccgccaggcccccggcaagggcctcgagtgggtcgcctccatctcctacgacggctccgacaagtaccacgccggcctcgtctggggccgcttcatcatctcccgcgacaactccaagaacaccctctacctccagatgaactccctccgcgccgaggacaccgccctctactactgcgtccgcgacgagcgcgagtccgagtgcgagctctgggagtccgactactacaacttcggcaagaagctcccctgcgtcaagccccgcggcgtcgccggcaccctcgacatctggggccagggcaccaccgtcatcgtctcctcc

SEQ ID NO: 17012 - RNA, 432 nt, synthetic construct
  misc_feature 1..432: note = derived and/or modified sequence opt2 from anti-HIV_cap256-119-183891_VR-Chain
  source 1..432: mol_type = other RNA
caggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcacccgctacgacggctccgacaagtactacctcgactccgtcaagggccgcttcaccatctcccgcgacaactccaagtacaccctcttcctccagatggtctccctccgcaccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17013 - RNA, 435 nt, synthetic construct
  misc_feature 1..435: note = derived and/or modified sequence opt2 from anti-HIV_cap256-119-183631_VR-Chain
  source 1..435: mol_type = other RNA
caggtccagctcgtccagtccggcggcggcgtcgtccagcccggccgctccctccgcctctcctgcgccgcctccaagttcaccttctccacctacaccctccactgggtccgccaggcccccggcaagggcctcgagtgggtcgccgtcatctcccacgacggcggcaaccgcttctacgccgactccgtcaagggccgcttcaccatctcccgcgacaactccaagaacaacctcttcctccagatgaactccctccgcgtcgaggacaccgccctctactactgcgcccgcgacctccgcgagatggagtgcgaggagtggaccctctacaactactacgacttcggctcccgcggcccctgcgtcgacccccgcggcgtcgtcggctccttcgacgtctggggccagggcaccatggtcaccgtctcctcc

SEQ ID NO: 17014 - RNA, 432 nt, synthetic construct
  misc_feature 1..432: note = derived and/or modified sequence opt2 from anti-HIV_cap256-119-182676_VR-Chain
  source 1..432: mol_type = other RNA
caggtccagctcgtcgagtccggcggcggcgtcgtccagcccggcaagtccctccgcctctcctgcgtcgtctccggcttcaccttctccaactaccccatgcactgggtccgccaggcccccggcaagggcctcgagtgggtcgcctccatctccttcgccggcatcaagaagtactacggcgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17015 - RNA, 432 nt, synthetic construct
  misc_feature 1..432: note = derived and/or modified sequence opt2 from anti-HIV_cap256-119-180772_VR-Chain
  source 1..432: mol_type = other RNA
caggtccagctcgtcgagtccggcggcggcgtcgtccagcccggccgctccctccgcctctcctgcgccgcctccgagttcaccttctccaactacgccatgcactgggtccgccaggcccccggcaagggcctcgagtgggtcgcctccatctccttcgacggccgcgacaagtaccactcctccctcgtctggggccgcctcaccatctcccgcgacaactccaagtccaccctcttcctccagatgaactccctccgccccgaggacaccgccctctactactgcgcccgcgacgtccgcgagtccgagtgcgaggagtggcagtccgactactacgccttctaccgcaagctcccctgcgtcaagccccgcggcgtcgccggcaccctcgacatctggggccagggcaccatggtcaccgtctcctcc

SEQ ID NO: 17016 - RNA, 435 nt, synthetic construct
  misc_feature 1..435: note = derived and/or modified sequence opt2 from anti-HIV_cap256-119-180508_VR-Chain
  source 1..435: mol_type = other RNA
caggtccacctcgtcgagtccggcggcggcgtcgtccagcccggccgctccctccgcctctcctgcgccgcctcccacttctccctctcctcctacggcatgcactgggtccgccagacccccggcaagggcctcgagtgggtcgccggcatctccttcgccggcgtcaagacctactacggcacctccgtcaagggccgcttcaccatctcccgcgacaactccaagaacaacctctacctccagatgaactccctccgccccgaggacaccgccctctactactgcgcccgcgacctccgcgagatggagtgcgaggagtggaagctctacaactactacgacttccgcacccgcggcccctgcgtcgacccccgcggcgtcgtcggctccttcgacgtctggggccagggcaccgtcgtcaccgtctcctcc

SEQ ID NO: 17017 - RNA, 432 nt, synthetic construct
  misc_feature 1..432: note = derived and/or modified sequence opt2 from anti-HIV_cap256-119-180260_VR-Chain
  source 1..432: mol_type = other RNA
gaggtccagctcgtcgagtccggcggcggcgtcgtccgccccggcggctccctccgcctctcctgcgccgcctcccagttcaccttctccaacttcggcatgcactgggtccgccaggcccccggcaagggcctcgagtgggtcgcctccatctccttcgtcggcatcaagacccactacgccaactccgtccgcggccgcttcaccatctcccgcgaccagtccaagaacaccctctacctccagatgaactccgtccgcgtcgaggacaccggccgctactactgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17018 - RNA, 432 nt, synthetic construct
  misc_feature 1..432: note = derived and/or modified sequence opt2 from anti-HIV_cap256-119-180173_VR-Chain
  source 1..432: mol_type = other RNA
gaggtccagctcgtcgagtccggcggcggcctcgtccagcccggcggctccctccgcctctcctgcgccgcctccggcttcaccgtctcctccaactacatgtcctgggtccgccaggcccccggcaagggcctcgagtgggtcgcctccatctccttcgccggcaccaagaagcactacggcaactccgtcaagggccgcttcaccatctcccgcgacaactccaagaacaccctctacctccagatgaactccctccgcggcgaggacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17019 - RNA, 432 nt, synthetic construct
  misc_feature 1..432: note = derived and/or modified sequence opt2 from anti-HIV_cap256-119-179839_VR-Chain
  source 1..432: mol_type = other RNA
caggtccagctcgtcgagtccggcggcggcgtcgtccagcccggccgctccctccgcctctcctgcgccgcctccggcttctccttcggcacctccgacgtccactgggtccgccaggcccccggcgagggcctcgagtgggtcgccctcatctccttcgacggccgccagaaggacctcgccgactccgtccgcggccgcttcaccatctcccgcgactcctccaagaacaccctctacctcgagatgaactccctccgccccgaggacaccgccctctactactgcgccaaggacatgcgcggctacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17020 - RNA, 423 nt, synthetic construct
  misc_feature 1..423: note = derived and/or modified sequence opt2 from anti-HIV_cap256-119-179262_VR-Chain
  source 1..423: mol_type = other RNA
caggtccagctcgtcgagtccggcggccgcgtcgtccagtccggcggctccctccgcctctcctgcggcgcctccggcttctccttcaccacctccgccatgcactgggtccgccaggcccccggcaagggcctcgagtgggtcgccatcaacggcgccaacaagcactacgccgagtccgtcaagggccgcttcaccatctcccgcgacaactccaagaacaccctcttcctcgagatgaactccctccgccccgacgacaccgccctctacttctgcgtcaaggaccagcgcgaggacgagtgcgaggagtggtggtccgactactacgacttcggccgcgagcagccctgcctcgacccccgcggcgtcgtcggcatcttcgacctctggggccagggcaccatggtcaccgtctcctcc

SEQ ID NO: 17021 - RNA, 432 nt, synthetic construct
  misc_feature 1..432: note = derived and/or modified sequence opt2 from anti-HIV_cap256-119-178995_VR-Chain
  source 1..432: mol_type = other RNA
caggtccagctcgtcgagtccggcggcggcgtcgtccagcccggcaagtccctccgcctctcctgcgccgcctccggcttcaccctcacccgcttcgccatgcactgggtccgccaggcccccggcaagggcctcgagtgggtcgccgtcatctggtacgacggctccaacaagtactacgccgactccgtcaagggccgcttcaccgtctcccgcgacaactccaagaacaccctctacctccagatgaactccctccgcaccgaggacaccgccctctactactgcgtccgcgaccgccgcgagtccgagtgcgagctctgggagtccgactactacaacttcggccgccgcctcccctgcgtcaagccccgcggcgtcgccggcatcctcgacatctggggccagggcaccaccgtcaccgtctccccc

SEQ ID NO: 17022 - RNA, 432 nt, synthetic construct
  misc_feature 1..432: note = derived and/or modified sequence opt2 from anti-HIV_cap256-119-178455_VR-Chain
  source 1..432: mol_type = other RNA
gaggtccagctcgtcgagtccggcggcggcctcgtccagcccggcggctccctccgcctctcctgcgtcgtctccggcttcaccttctccaacttctggatgtcctgggtccgccaggcccccggcaagggcctcgagtgggtcgcctccatctcctacgacggccgcgacaagtaccactcctccctcgtctggggccgcctcaccatctcccgcgacaactccaagtccaccctcttcctccagatgaactccctccgcgccgaggacaccgccctctactactgcgcccgcgacctccgcgagtccgagtgcgaggagtggcagtccgactactacgccttctacaagaagctcccctgcgtcaagccccgcggcgtcgccggcaccctcgacatctggggccagggcaccatggtcaccgtctcctcc

SEQ ID NO: 17023 - RNA, 438 nt, synthetic construct
  misc_feature 1..438: note = derived and/or modified sequence opt2 from anti-HIV_cap256-119-177993_VR-Chain
  source 1..438: mol_type = other RNA
caggtccacctcgtcgagtccggcggcggcgtcgtccagcccggcaagtccctccgcatctactgcgccgtctccgagttcaccttctccaactacgccatgcactgggtccgcctcgcccccggccgcggcctccagtggctcgccgtcatctcctacgacggctccaagaagtactacgccgactccctcgagggccgcttcaccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggcgagcgcgcccccctccccaaggtccccggccccggccccggctggaacctcgacatgtggggccacggcaccatggtcaccgtctcctcc

SEQ ID NO: 17024 - RNA, 438 nt, synthetic construct
  misc_feature 1..438: note = derived and/or modified sequence opt2 from anti-HIV_cap256-119-177727_VR-Chain
  source 1..438: mol_type = other RNA
caggtccagctcgtcgagtccggcggcggcgtcgtccagcccggccgctccctccgcctctcctgcgccgcctccggcttcaccctctcccgctacgacatgcactgggtccgccaggcccccggcaagggcctcgagtgggtcgcctccatctccaaggacggcaccaagaagtaccacggcgactccgtctggggccgcttcatcatctcccgcgacaactccaagaacaccctcttcctccagatgtcctccctccgcgccgaggacaccgccctctacttctgcgtccgcgaccagcgcgaggccgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17025 - RNA, 432 nt, synthetic construct
  misc_feature 1..432: note = derived and/or modified sequence opt2 from anti-HIV_cap256-119-176746_VR-Chain
  source 1..432: mol_type = other RNA
gaggtccagctcgtcgagtccggcggcggcctcgtccagcccggcggctccctccgcctctcctgcgccgcctccgacttcaccttcgacgactacgccatgcactgggtccgccaggcccccggcaagggcctcgagtgggtcggcggcatctcctacgacggctccgacaagtaccacaccaactccgtctggggccgcttcatcgtctcccgcgacaactccaagaacaccctctacctccagatgaactccctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17026 - RNA, 432 nt, synthetic construct
  misc_feature 1..432: note = derived and/or modified sequence opt2 from anti-HIV_cap256-119-176241_VR-Chain
  source 1..432: mol_type = other RNA
caggtccagctcgtcgagtccggcggcggcgtcgtccagcccggccgctccctccgcctctcctgcgccgcctccggcttcaccttctccaactacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17027 - RNA, 432 nt, synthetic construct
  misc_feature 1..432: note = derived and/or modified sequence opt2 from anti-HIV_cap256-119-175215_VR-Chain
  source 1..432: mol_type = other RNA
caggtccagctcgtcgagtccggcggcggcgtcgtccagcccggccgctccctccgcctctcctgcgccgtctcccagttcaccttcggccgctacggcatgtactgggtccgccaggcccccggcaagggcctcgagtgggtcgccggcatctcctacgacggctccgacaagtaccacaccaactccgtctggggccgcttcatcgtctcccgcgacaactccaagaacatgctctacctccagatgaacaacctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17028 - RNA, 432 nt, synthetic construct
  misc_feature 1..432: note = derived and/or modified sequence opt2 from anti-HIV_cap256-119-173928_VR-Chain
  source 1..432: mol_type = other RNA
ggcgtcgagctcctcgagtccggcggcggcctcgtcgagcccggcggctccctccgcctctcctgcgtcggctcccagttctccttcgaccgctacggcatgcactgggtccgccaggcccccggcaagggcctcgagtgggtcgccgccgtctccttcgacggcaccgacaagtaccacgccgacgacgtctggggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacctcggcaagcagctcccctgccgcaagtcccgcggcgtcgccggcgtcctcgacaagtggggcctcggcaccatggtcaccgtctcctcc

SEQ ID NO: 17029 - RNA, 432 nt, synthetic construct
  misc_feature 1..432: note = derived and/or modified sequence opt2 from anti-HIV_cap256-119-173495_VR-Chain
  source 1..432: mol_type = other RNA
caggtccagctcgtcgagtccggcggcggcgtcgtccagcccggcaagtccctccgcctctcctgcgccgcctcccgcttcaccttcaaccgctacggcatgcactgggtccgccaggcccccggcaagggcctcgagtgggtcgccgccatctccttcgacggcaccgacaagtaccactccgacgacgtctggggccgcttcaccatctcccgcgacaactccaagaacaccctctacctccagatgaactccctccgcgccgaggacaccgccgtctactactgcgccaaggacctccgcgaggacgagtgcgaggagcgctggtccgactactacgacttcggcaagcagctcccctgccgcaagtcccgcggcgtcgccggcatcttcgacaactggggccagggcaccatggtcaccgtctcctcc

SEQ ID NO: 17030 - RNA, 432 nt, synthetic construct
  misc_feature 1..432: note = derived and/or modified sequence opt2 from anti-HIV_cap256-119-172882_VR-Chain
  source 1..432: mol_type = other RNA
caggtccagctcgtcgagtccggcggcggcgtcgtccagcccggccgctccctcaccctctcctgcgaggtctccggcttcaccttcaagacctacggcatgcactgggtccgccaggcccccggcaagggcctcgagtgggtcgcctccatctcctacgacggctccgacaagtaccacgccgaccgcgtctggggccgcttcaccatctcccgcgacaactccaagaacaccctctacctccagatgaactccctccgcgccgaggacaccgccctctactactgcgtccgcgacgcccgcgagtccgagtgcgagctctgggagtccgactactacaacttcggccgcaagctcccctgcgtcaagccccgcggcgtcgccggcaccctcgacatctggggccagggcaccatggtcaccgtctcctcc

SEQ ID NO: 17031 - RNA, 432 nt, synthetic construct
  misc_feature 1..432: note = derived and/or modified sequence opt2 from anti-HIV_cap256-119-172429_VR-Chain
  source 1..432: mol_type = other RNA
gaggtccagctcgtcgagaccggcggcggcctcatccagcccggcggctccctccgcctctcctgcgtcgcctcccagttcaccttctccggctgcggcctccactgggtccgccaggcccccggcaagggcctcgagtgggtcgcctccatctccttcgccggcaccaagaagcactacggcaactccgtcaagggccgcttcaccatctcccgcgacaactccaagaacaccctctacctcgagatgaacaccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtctccgtctcctcc

SEQ ID NO: 17032 - RNA, 432 nt, synthetic construct
  misc_feature 1..432: note = derived and/or modified sequence opt2 from anti-HIV_cap256-119-172223_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggccgcgacttctaccacgcccgctccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaaggacccctgcgtcaagccccgcggcgtcgtcggcgtcctcgacatctggggccagggcaccctcgtcaccgtctcctcc

SEQ ID NO: 17033 - RNA, 432 nt, synthetic construct
  misc_feature 1..432: note = derived and/or modified sequence opt2 from anti-HIV_cap256-119-171838_VR-Chain
  source 1..432: mol_type = other RNA
caggtccagctcggcgagtccggcggcggcgtcgtccagcccggccgctccctccgcctctcctgcgccgcctccggcttcaccttctccaccttcgccatgcactgggtccgccaggcccccggcaagggcctcgagtgggtcgccgtcatctcctacgacggctccaacaagtactacgccgactccgtcaagggccgcttcgccatctcccgcgacaacgccaagaacctcctccacctccagatgaactccctccgccccgaggacaccgccctctactactgcgccaaggacctccaggaggacgagtgcgaggagtggtggtccgactactacgacttcggcaagcagctcccctgccgcaagtcccgcggcgtcgccggcatcttcgacgactggggccagggcaccatggtcaccgtctcctcc

SEQ ID NO: 17034 - RNA, 432 nt, synthetic construct
  misc_feature 1..432: note = derived and/or modified sequence opt2 from anti-HIV_cap256-119-171587_VR-Chain
  source 1..432: mol_type = other RNA
gaggtccagctcgtcgagtccggcggcggcctcgtccagcccggcggctccctccgcctctcctgcgccgcctccggcttcaccttctccgactactacatgtcctggatccgccaggcccccggcaagggcctcgagtgggtcgcctccatctccttcgccggcaccaagcagcactacggcaactccgtcaagggccgcttcaccatctcccgcgacaactccaagaacaccgtctacctccagatgaactccctccgcctcgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17035 - RNA, 432 nt, synthetic construct
  misc_feature 1..432: note = derived and/or modified sequence opt2 from anti-HIV_cap256-119-169596_VR-Chain
  source 1..432: mol_type = other RNA
ctcgtccagctcgtcgagtccggcggcggcgtcgtccagcccggccgctccctccgcctctcctgcaccgcctccggcttcaccttctcctccttcgccatgcaccgcgtccgccagacccccggcaagggcctcgagtgggtcgcctccatctcctacgacggctccgacaagtaccacgccgaccgcgtctggggccgcttcaccatctcccgcgacaactccaagaacaccctctacctccagatgaactccctccgcgccgaggacaccgccctctactactgcgtccgcgacgcccgcgagtccgagtgcgagctctgggagtccgactactacaacttcggccgcaagctcccctgcgtcaagccccgcggcgtcgccggcaccctcgacatctggggccagggcaccatggtcaccgtctcctcc

SEQ ID NO: 17036 - RNA, 432 nt, synthetic construct
  misc_feature 1..432: note = derived and/or modified sequence opt2 from anti-HIV_cap256-119-169523_VR-Chain
  source 1..432: mol_type = other RNA
caggtccagctcgtcgagtccggcggcggcgtcgtccagcccggcgagtccctccgcctctcctgcgccgcctccggcttctccttcggcacctccgacgtccactgggtccgccaggcccccggcgagggcctcgagtgggtcgcctccatctccttcgccggcatcaagaagtactacggcgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17037 - RNA, 432 nt, synthetic construct
  misc_feature 1..432: note = derived and/or modified sequence opt2 from anti-HIV_cap256-119-169462_VR-Chain
  source 1..432: mol_type = other RNA
gaggtccagctcgtcgagtccggcggcggcctcgtccagcccggcggctccctccgcctctcctgcgccgcctccggcttcaccttcaccacctactccctccactgggtccgccagtcccccggcaagggcctcgagtgggtcgccgccatctccttcgccggcaccaaggagaactacgccaactccgtccgcggccgcttcaccatctcccgcgacaactccaagaacaccctctacctccagatgaactccctccgcgccgaggacaccgccctctactactgcaccaaggacatgcgcgagtacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17038 - RNA, 432 nt, synthetic construct
  misc_feature 1..432: note = derived and/or modified sequence opt2 from anti-HIV_cap256-119-169092_VR-Chain
  source 1..432: mol_type = other RNA
gaggtccagctcgtcgagtccggcggcggcctcgtccagcccggcggctccctccgcctctcctgcgtcatctccggcttcaccttctcctcctacgagatgaactgggtccgccaggcccccggcaagggcctcgagtgggtcgccggcatctcctacgacggccgcgacaagtaccacgcccacttcgtctggggccgcatcaccatctcccgcgacaactccaagaacaccctctacctccagatgaactccctccgcgccgaggacaccgccctctaccactgcgtccgcgacctccgcgagtccgagtgcgagctctgggagtccgactactacgacttcggcaagaagctcccctgcgtcaagccccgcggcgtcgccggcatcttcgacctctggggccagggcaccatggtcaccgtctcctcc

SEQ ID NO: 17039 - RNA, 432 nt, synthetic construct
  misc_feature 1..432: note = derived and/or modified sequence opt2 from anti-HIV_cap256-119-168680_VR-Chain
  source 1..432: mol_type = other RNA
caggtccagctcgtcgagtccggcggcggcgtcgtccagcccggccgctccctccgcgtctcctgcgccgcctcccacttcaccttctcccgctacggcatgcactgggtccgccaggcccccggcaagggcctcgagtgggtcgcctccatctcctacgacggccgcgacttctaccacgcccgctccgtctggggccgcttcgccatctcccgcgacaactccaagaacaccctccacctccagatgaactccctccgcaccgaggacaccgccctctaccactgcgtccgcgacctccgcgagtccgagtgcgagctctgggagtccgactactacgacttcggcaagaagctcccctgcgtcaagccccgcggcgtcgccggcaccttcgacctctggggccagggcaccatggtcaccgtctcctcc

SEQ ID NO: 17040 - RNA, 438 nt, synthetic construct
  misc_feature 1..438: note = derived and/or modified sequence opt2 from anti-HIV_cap256-119-166385_VR-Chain
  source 1..438: mol_type = other RNA
caggtccagctcgtcgagtccggcggcggcgtcgtccaccccggccgctccctccgcctctcctgcgccgcctccggcttctccttcggcaacttcggcatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17041 - RNA, 432 nt, synthetic construct
  misc_feature 1..432: note = derived and/or modified sequence opt2 from anti-HIV_cap256-119-165943_VR-Chain
  source 1..432: mol_type = other RNA
gaggtccagctcgtcgagtccggcggcggcctcgtccagcccggccgctccctccgcctctcctgcgccgtctccggcttcaccgtctcctccaactacatgtcctgggtccgccaggcccccggcaagggcctcgagtgggtcgcctccatctccttcgccggcatcaagaagtactacggcgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17042 - RNA, 432 nt, synthetic construct
  misc_feature 1..432: note = derived and/or modified sequence opt2 from anti-HIV_cap256-119-165738_VR-Chain
  source 1..432: mol_type = other RNA
gaggtccagctcgtcgagtccggcggcggcctcgtccagcccggccgctccctccgcctctcctgcgccgcctccggcttcaccttcgacgactacgccatgaactgggtccgccaggcccccggcaagggcctcgagtgggtcgccaccatctccttcgacggcaccgacaagtaccacgccgacgacgtctggggccgcttcaccatctcccgcgacaactccaagaagaccctctacctccagatgaactccctccgcgccgaggacaccgccctctactactgcgccaaggacctccgcgaggacgagtgcgaggagtggtggtccgactactacgacctcggcaagcagctcccctgccgcaagtcccgcggcgtcgccggcgtcctcgacaagtggggcctcggcaccatggtcaccgtctcctcc

SEQ ID NO: 17043 - RNA, 432 nt, synthetic construct
  misc_feature 1..432: note = derived and/or modified sequence opt2 from anti-HIV_cap256-119-164913_VR-Chain
  source 1..432: mol_type = other RNA
caggaccacctcgtcgagtccggcggcggcggcgtccagcccggcaagtccctccgcctctcctgcgccgcctccggcttcaccttctccgcccacgccatgcactgggtccgccaggcccccggcaagggccccgagtgggtcgccgtcatctcccacgacggcggccagcagttctaccgcgagtccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17044 - RNA, 432 nt, synthetic construct
  misc_feature 1..432: note = derived and/or modified sequence opt2 from anti-HIV_cap256-119-164167_VR-Chain
  source 1..432: mol_type = other RNA
gaggtccgcctcgtcgagtccggcggcggcctcatccagcccggcggctccctccgcctctcctgcgccgcctccggcctcaccgtctcctccaaccacatgtcctgggtccgccaggcccccggcaagggcctcgagtgggtcgcctccatctcctacgacggccgcgacttctaccacgcccgctccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17045 - RNA, 432 nt, synthetic construct
  misc_feature 1..432: note = derived and/or modified sequence opt2 from anti-HIV_cap256-119-163558_VR-Chain
  source 1..432: mol_type = other RNA
cagatgcagctcgtcgagtccggcggcggcgtcgtccagcccggccgctccctcaccctctcctgcgccgcctcccagttcaacttcgccaactacggcatgcactgggtccgccaggcccccggcaagggcctcgagtgggtcgcctccatctcctacgacggctccgacaagtaccacgccgaccgcgtctggggccgcttcaccatctcccgcgacaactccaagaacaccctctacctccagatgaactccctccgcgccgaggacaccgccctctactactgcgtccgcgacgcccgcgagtccgagtgcgagctctgggagtccgactactacaacttcggccgcaagctcccctgcgtcaagccccgcggcgtcgccggcaccctcgacatctggggccagggcaccatggtcaccgtctcctcc

SEQ ID NO: 17046 - RNA, 432 nt, synthetic construct
  misc_feature 1..432: note = derived and/or modified sequence opt2 from anti-HIV_cap256-119-162043_VR-Chain
  source 1..432: mol_type = other RNA
caggtccagctcgtcgagtccggcggcggcgtcgtccagcccggccgctccctccgcgtctcctgcgccgcctcccacttcaccttctcccgctacggcatgcactgggtccgccaggcccccggcaagggcctcgagtgggtcaccggcatctccttcgccgccaccaagacctactacggcgactccgtccgcggccgcttcaccgtctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcatcctcgacctctggggccagggcaccatggtcaccgtctcctcc

SEQ ID NO: 17047 - RNA, 432 nt, synthetic construct
  misc_feature 1..432: note = derived and/or modified sequence opt2 from anti-HIV_cap256-119-161718_VR-Chain
  source 1..432: mol_type = other RNA
caggtccagctcgtcgagtccggcggcggcgtcgtccagcccggcaagtccctccgcctctcctgcgccgcctcccacttctccttcaaccgctacggcatgcactgggtccgccaggcccccggcaagggcctcgagtgggtcgccgccatctcctacgacggcaccgacaagtaccacgccgaccaggtctggggccgcttcaccatctcccgcgacaactccaagaacaccctctacctccagatgaactccctccgccccgaggacaccgccctctactactgcgccaaggacctccgcgaggacgagtgcgaggagtggtggtccgactactacgacctcggcaagcagctcccctgccgcaagtcccgcggcgtcgccggcatcttcgacaagtggggccagggcaccatggtcaccgtctcctcc

SEQ ID NO: 17048 - RNA, 432 nt, synthetic construct
  misc_feature 1..432: note = derived and/or modified sequence opt2 from anti-HIV_cap256-119-161675_VR-Chain
  source 1..432: mol_type = other RNA
caggtccagctcgtcgagtccggcggcggcgtcgtccagcccggccgctccctccgcctctcctgcaccgcctccggcttcaccttctccatctactccatgaactgggtccgccaggcccccggcaagggcctcgactgggtcgccggcatctccttcgccgccaccaagacctactacggcggctccgtcaagggccgcttcaccgtctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17049 - RNA, 432 nt, synthetic construct
  misc_feature 1..432: note = derived and/or modified sequence opt2 from anti-HIV_cap256-119-161053_VR-Chain
  source 1..432: mol_type = other RNA
caggtccacctcgtcgagtccggcggcggcgtcgtccagcccggcacctccctccgcctctcctgcgtcgcctccggcttcaccttctccaacttcgccatgcactgggtccgccaggcccccggcaagggcctcgagtgggccgccatcatctccacccgcggcaacaaccgcaactacgccgactccgtccgcggccgcttcaccgtctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcatcctcgacctctggggccagggcaccatggtcaccgtctcctcc

SEQ ID NO: 17050 - RNA, 432 nt, synthetic construct
  misc_feature 1..432: note = derived and/or modified sequence opt2 from anti-HIV_cap256-119-159499_VR-Chain
  source 1..432: mol_type = other RNA
caggtccagctcgtcgagtccggcggcggcgtcgtccagcccggccgctccctccgcctctcctgcgccgcctccggcttcgccttctcccactacggcatcttctgggtccgccaggcccccggcaagggcctcgagtgggtcgcctccatctccttcgacggccgcgactactaccactccccccacgtctggggccgcctcaccatctcccgcgacaactccaagaacaccctctacctccagatgaactccctccgcgccgaggacaccgccctctactactgcgcccgcgacctccgcgagtccgagcgcgaggagtgggagtccgactactacgacttcggcaagaagggcccctgcgtcaagccccgcggcgtcgccggctccctcgacatgtggggccagggcaccatggtcatcgtctcctcc

SEQ ID NO: 17051 - RNA, 432 nt, synthetic construct
  misc_feature 1..432: note = derived and/or modified sequence opt2 from anti-HIV_cap256-119-159114_VR-Chain
  source 1..432: mol_type = other RNA
gaggtccagctcgtcgagtccggcggcggcctcgtccagcccggcggctccctccgcctcgcctgcgccgcctccggcctcaccttccgcaagcacggcatgcactgggtccgccaggcccccggcaagggcctcgagtgggtctcctacatctcctccgacggcgtcaacaactacctcatcgactccgtccgcggccgcttcaccgtctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17052 - RNA, 432 nt, synthetic construct
  misc_feature 1..432: note = derived and/or modified sequence opt2 from anti-HIV_cap256-119-156751_VR-Chain
  source 1..432: mol_type = other RNA
gaggtccagctcctcgagtccggcggcggcctcgtccagcccggcggctccctccgcctctcctgcgccgcctccggcttcgccttctcctcctacggcatgcactgggtccgccaggcccccggcaagggcctcgagtgggtcgcctccatctcctacgacggccgcgacttctaccacgcccgctccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17053 - RNA, 432 nt, synthetic construct
  misc_feature 1..432: note = derived and/or modified sequence opt2 from anti-HIV_cap256-119-155656_VR-Chain
  source 1..432: mol_type = other RNA
gaggtccagctcgtcgagtccggcggcggcctcgtccagcccggcggctccctccgcctctcctgcgccgcctccggcatcaccttctcctcctacggcatgcactgggtccgccaggcccccggcaagggcctcgagtgggtcgccttcatccgctacgacggctcctccaagtactacgccgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17054 - RNA, 432 nt, synthetic construct
  misc_feature 1..432: note = derived and/or modified sequence opt2 from anti-HIV_cap256-119-154420_VR-Chain
  source 1..432: mol_type = other RNA
caggtccgcctcgtcgagtccggcggcggcgtcgtccagcccggccgctccctccgcatctcctgcgccgcctcccagttcatgttctcccgctacggcatgcactgggtccgccaggcccccggcaagggcctcgagtgggtcgcctccatctcctacgacggcaccgacaagtaccacgccgacctcgtctggggccgcttcaccatctcccgcgacaactccaagaacaccctctacctccagatgaactccctccgcgccgaggacaccgccctctactactgcgcccgcgacctccgcgagtccgagtgcgaggagtgggagtccgactactacgacttcggcaagaagggcccctgcgtcaagccccgcggcgtcgccggctccctcgacatgtggggccagggcaccatggtcatcgtctcctcc

SEQ ID NO: 17055 - RNA, 432 nt, synthetic construct
  misc_feature 1..432: note = derived and/or modified sequence opt2 from anti-HIV_cap256-119-153954_VR-Chain
  source 1..432: mol_type = other RNA
gaggtccaggtcctcgagtccggcggcggcctcgtccagcccggcggctccctccgcctctcctgcgtcgcctcccagttcaccttctccggctgcggcctccactgggtccgccaggcccccggcaagggcctcgagtgggtcgcctccatctccttcgccggcaccaagaagcactacggcaactccgtcaagggccgcttcaccatctcccgcgacaactccaagaacaccgtctacctcgagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17056 - RNA, 432 nt, synthetic construct
  misc_feature 1..432: note = derived and/or modified sequence opt2 from anti-HIV_cap256-119-153864_VR-Chain
  source 1..432: mol_type = other RNA
caggtccacctcgtcgagtccggcggcggcgtcgtccagcccggcggctccctccgcctctcctgcgccgcctccggcttcaccttctccggctgcggcctccactgggtccgccaggcccccggcaagggcctcgagtgggtcgcctccatctccttcgccggcaccaagaagcactacggctcctccgtccgcggccgcttctccatctcccgcgacaactccaagaacaccctctacctccagatgaactccctccgcaccgaggacaccgccctctacttctgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17057 - RNA, 432 nt, synthetic construct
  misc_feature 1..432: note = derived and/or modified sequence opt2 from anti-HIV_cap256-119-153793_VR-Chain
  source 1..432: mol_type = other RNA
gaggtccagctcgtcgagtccggcggcggcgtcgtccagcccggcggctccctccgcctctcctgcgccacctccggcttcaccttcggcaccttcggcatgcactgggtccgccaggcccccggcaagggcctcgactgggtcgcctacatccgctacgacggcaagaccaagaactacggcgagtccgtcaagggccgcttcaccatctcccgcgacaactccaagaacaccatgtccctccagatgaactccctccgccccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17058 - RNA, 432 nt, synthetic construct
  misc_feature 1..432: note = derived and/or modified sequence opt2 from anti-HIV_cap256-119-153462_VR-Chain
  source 1..432: mol_type = other RNA
caggtccagctcgtcgagtccggcggcggcgtcgtccagcccggcggctccctccgcctctcctgcgccgcctccggcttcaccttctccaactacggcatgcagtgggtccgccaggcccccggcaagggcctcgagtgggtcgccgccatctcctacgacggccgcaacgagtactacgccgagtccgtcaagggccgcttcaccatctcccgcgacaacttcaagtccaccctcttcctccagatgaactccctccgcgccgaggacaccgccctctactactgcgcccgcgacctccgcgagtccgagtgcgaggagtgggagtccgactactacgccttctaccgcaagctcccctgcgtcaagccccgcggcgtcgccggcaccctcgacatctggggccagggcaccatggtcaccgtctcctcc

SEQ ID NO: 17059 - RNA, 438 nt, synthetic construct
  misc_feature 1..438: note = derived and/or modified sequence opt2 from anti-HIV_cap256-119-153124_VR-Chain
  source 1..438: mol_type = other RNA
caggtccagctcgtcgagtccggcggcggcgtcgtccagcccggccgctccctcaccctctcctgcatcgcctcccagttcaacttcgcctcctacggcatgcactgggtccgccaggcccccggcaagggcctcgagtgggtcgcctccatctcccacgacggcaccaagaagtaccacgccgagtccgtctggggccgcttcaccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17060 - RNA, 438 nt, synthetic construct
  misc_feature 1..438: note = derived and/or modified sequence opt2 from anti-HIV_cap256-119-153025_VR-Chain
  source 1..438: mol_type = other RNA
cagatgcagctcgtcgagtccggcggcggcgtcgtccagcccggcaagtccctcaccctctcctgcgccgcctcccagttcaccttctccaactacggcatgcactgggtccgccaggcccccggcaagggcctcgagtgggtcgcctccatctccaacgacggcaacaagaagtaccacggcgactccgtctggggccgcctcaccatctcccgcgacaactccaagaacaccctcttcctccagatgaactccctccgccccgaggacaccgccctctacttctgcgtcaaggaccagcgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17061 - RNA, 432 nt, synthetic construct
  misc_feature 1..432: note = derived and/or modified sequence opt2 from anti-HIV_cap256-119-152713_VR-Chain
  source 1..432: mol_type = other RNA
gaggtccagctcgtcgagtccggcggcggcctcgtccgccccggcggctccctccgcctctcctgcgccacctccggcttcaccttctcctcccactggatgtcctgggtccgccaggcccccggcaagggcctcgagtgggtcgccggcatctccttcgccggcaccaagacctactacggcgactccgtcaagggccgcttcaccgtctccaccgacatctccaagaacaccctctacctccaggtcaactccctccgccccgaggacaccgccatgtactactgcgcccgcgaccagcgctactacgagtgcgaggagtgggcctccgactactacgacttcggcaaggagcagccctgcctcgacccccgcggcgtcgtcggcatcttcgacatctggggccagggcaccatggtcaccgtctcctcc

SEQ ID NO: 17062 - RNA, 438 nt, synthetic construct
  misc_feature 1..438: note = derived and/or modified sequence opt2 from anti-HIV_cap256-119-151794_VR-Chain
  source 1..438: mol_type = other RNA
cacgtccagctcgtcgagtccggcggcggcgtcgtccagcccggcacctccctccgcctctcctgcgtcgcctccgagttctccttcaagaactacggcatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17063 - RNA, 438 nt, synthetic construct
  misc_feature 1..438: note = derived and/or modified sequence opt2 from anti-HIV_cap256-119-150980_VR-Chain
  source 1..438: mol_type = other RNA
caggtccagctcgtcgagtccggcggcggcgtcgtccagcccggcaagtccctccgcctctcctgcgccgcctccggcttcatcctctccaactacgccatgcactgggtccgccaggcccccggcaagggcctcgagtgggtcgcctccatctccaacgacggctccaagaagtaccacggcgactccgtctgggcccgcttcatcatctcccgcgacaactccaagaacaccctcttcctccagatgtcctccctccgcgccgaggacaccgccctctacttctgcgtccgcgaccaccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17064 - RNA, 432 nt, synthetic construct
  misc_feature 1..432: note = derived and/or modified sequence opt2 from anti-HIV_cap256-119-148895_VR-Chain
  source 1..432: mol_type = other RNA
caggtccagctcgtcgagtccggcggcggcgtcgtccagcccggccgctccctccgcctctcctgcgccgcctccggcttcaccttccgctcctacggcatgcactgggtccgccaggcccccggcaagggcctcgagtgggtcgccgtcatctcctccgacggcgacatcgagtactacacccagtccgtcaagggccgcttcaccatctcccgcgacaactccaagaacaccctctacctccagatgaacgccctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17065 - RNA, 438 nt, synthetic construct
  misc_feature 1..438: note = derived and/or modified sequence opt2 from anti-HIV_cap256-119-148848_VR-Chain
  source 1..438: mol_type = other RNA
cagatgcagctcgtcgagtccggcggcggcgtcgtccagcccggccgctccctcaccctctcctgcgccgcctcccagttctccttcacctcctacggcatgcactgggtccgccaggcccccggcaagggcctcgagtgggtcgcctccatctccaacgacggcaccaagaagtaccacggcgagtccgtctgggaccgcttctccatctcccgcgacaactccaagaacaccctcttcctccagatgaactccctccgcgtcgaggacaccgccctctacttctgcgtcaaggaccagcgcgaggacgagtgcgaggagtggtggtccgactactacgacttcggcaaggagctcccctgccgcaagtggaagacccgcggcgtcgccggcatcctcgacaactggggccagggcaccatgctcaccgtctcctcc

SEQ ID NO: 17066 - RNA, 432 nt, synthetic construct
  misc_feature 1..432: note = derived and/or modified sequence opt2 from anti-HIV_cap256-119-148743_VR-Chain
  source 1..432: mol_type = other RNA
caggtccagctcgtcgagtccggcggcggcgtcgtccagcccggccgctccctcaccctctcctgcgccgcctcccagttcaacttcgccaactacggcatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggcaagaagctcccctgccgcaagtcccgcggcctcgccggcatcttccacgtctggggccacggcaccatggtcaccgtctcctcc

SEQ ID NO: 17067 - RNA, 432 nt, synthetic construct
  misc_feature 1..432: note = derived and/or modified sequence opt2 from anti-HIV_cap256-119-148595_VR-Chain
  source 1..432: mol_type = other RNA
gaggtccagctcgtcgagtccggcggcggcctcgtccagcccggcggctccctccgcctctcctgcgccgcctcccgcttcaccttcgacaactacggcatgcactgggtccgccaggcccccggcaagggcctcgagtgggtcgccctcctcaactacgacggctccaagaagtactacgtcgactccgtcaagggccgcttcatcatcttccgcgacaactccaagaacaccctcttcctccagatgaactccctccgccccgaggacaccgccctctacttctgcgtcaaggaccagcgcgaggacgcctgcgaggagtggtggtccgactactacgacttcggcaagaagctcccctgccgcaagtcccgcggcctcgccggcatcttccacgtctggggccacggcaccatggtcaccgtctcctcc

SEQ ID NO: 17068 - RNA, 432 nt, synthetic construct
  misc_feature 1..432: note = derived and/or modified sequence opt2 from anti-HIV_cap256-119-148490_VR-Chain
  source 1..432: mol_type = other RNA
caggtccagctcgtcgagtccggcggcggcgtcgtccagcccggccgctccctccgcctctcctgcgtcgcctccggcttcaccttctccgactacgccatgcactgggtccgccaggcccccggcaagggcctcgagtgggtcgccaccatctccttcgacggcgccgacaagtaccacgccgacgacgtctggggccgcttcaccatctcccgcgacaactccaagaacaccctctacctccagatgaactccctccgccccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17069 - RNA, 438 nt, synthetic construct
  misc_feature 1..438: note = derived and/or modified sequence opt2 from anti-HIV_cap256-119-148470_VR-Chain
  source 1..438: mol_type = other RNA
caggtccagctcgtcgagtccggcggcggcgtcgtccagcccggccgctccctccgcctctcctgcgtcgcctccggcttcaccttctcctcctacggcatccactgggtccgccaggcccccggcaagggcctcgagtgggtcgccgtcatctccgacgacggctccaagaagtaccacgaggagtccgtctggggccgcttcaccatctccaaggacaactccaagaacaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17070 - RNA, 432 nt, synthetic construct
  misc_feature 1..432: note = derived and/or modified sequence opt2 from anti-HIV_cap256-119-148107_VR-Chain
  source 1..432: mol_type = other RNA
gaggtccagctcgtcgagtccggcggcggcctcgtccagcccggcggctccctccgcctctcctgcgccgcctccggcttcaccgtctcctccaactacatgacctgggtccgccaggccccccgcaagggcctcgagtgggtcggctccatctcctacgacggctccgacaagtaccacaccaactccctctggggccgcttcatcgtctcccgcgacaactccaagaacaccctctacctccagatgaacaacctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17071 - RNA, 432 nt, synthetic construct
  misc_feature 1..432: note = derived and/or modified sequence opt2 from anti-HIV_cap256-119-147933_VR-Chain
  source 1..432: mol_type = other RNA
gagctccagctcgtcgagtccggcggcggcctcgtccagcccggctggtccctccgcctctcctgcgaggcctccggcttccccttctccgccttctggatgacctgggtccgccaggcccccggcaagggcctcggctgggtcgccttcatccgctacgacggctccaacaagtactacgccgactccgtcaagggccgcttcaccatctcccgcgacaactccatgaccaccctctacctccagatgaactccctccgcgccgaggacgccgccgtctactactgcgccaaggacctccgcgaggacgagtgcgaggagtggtggtccgactactacgacttcggcaagcgcctcccctgccgcaagtcccgcggcgtcgccggcgtcttcgacaagtggggccagggcaccatggtcaccgtctcctcc

SEQ ID NO: 17072 - RNA, 432 nt, synthetic construct
  misc_feature 1..432: note = derived and/or modified sequence opt2 from anti-HIV_cap256-119-147434_VR-Chain
  source 1..432: mol_type = other RNA
caggtccagctcgtcgagtccggcggcggcgtcgtccaggccggccgctccctccgcctctcctgcgccgcctcccagttcaccttcggccgctacggcatgcactgggtccgccaggcccccggcaagggcctcgagtgggtcggctccatctcctacgacggctccgacaagtaccacaccaactccgtctggggccgcttcatcgtctcccgcgacaactccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17073 - RNA, 435 nt, synthetic construct
  misc_feature 1..435: note = derived and/or modified sequence opt2 from anti-HIV_cap256-119-146106_VR-Chain
  source 1..435: mol_type = other RNA
caggtccagctcgtcgagtccggcggcggcgtcgtccagcccggccgctccctccgcctctcctgcgccgcctccggcttcaccttctcctcctccggcatgcactgggtccgccaggcccccggcaagggcctccagtgggtcgccgtcatctcctacgacggcggcaacaagtactacgccgactccgtcaagggccgcttcaccatctcccgcgacaactccaagaacaacctctacctccagatgaactccctccgccccgaggacaccgccctctactactgcgcccgcgacctccgcgagatggagtgcgaggagtggaagctctacaactactacgacttccgcacccgcggcccctgcgtcgacccccgcggcgtcgtcggctccttcgacgtctggggccagggcaccgtcgtcaccgtctcctcc

SEQ ID NO: 17074 - RNA, 438 nt, synthetic construct
  misc_feature 1..438: note = derived and/or modified sequence opt2 from anti-HIV_cap256-119-145604_VR-Chain
  source 1..438: mol_type = other RNA
gacgtccagctcgccgagtccggcggcggcctcgtccagcccggcggctccctccgcctctcctgcgtcgcctccggcttcaccttctcctccttcgagatgcactgggtccgccaggcccccggcaagggcctcgagtgggtcgcctccatctccaacgacggcaccaagcgctaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17075 - RNA, 438 nt, synthetic construct
  misc_feature 1..438: note = derived and/or modified sequence opt2 from anti-HIV_cap256-119-143998_VR-Chain
  source 1..438: mol_type = other RNA
caggtccagctcgtcgagtccggcggcggcgtcgtccagcccggccgctccctccgcctctcctgcgccgcctccggcttcaccttccgcaactacggcatgcactgggtccgccaggcccccggcaagggcctcgagtgggtcgcctccatctccaacgacggctccaagaagtaccacggcgactccgtctgggcccgcttcatcatctcccgcgacaactccaagaacaccctcttcctccagatgtcctccctccgcgccgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17076 - RNA, 438 nt, synthetic construct
  misc_feature 1..438: note = derived and/or modified sequence opt2 from anti-HIV_cap256-119-143441_VR-Chain
  source 1..438: mol_type = other RNA
gaggtccacctcgtcgagtccggcggcggcctcgcccagcccggccgctccctccgcctctcctgcgccgcctcccagttcaacttcgcctcctacggcatgcactgggtccgccaggcccccggcaagggcctcgagtgggtcgcctccatctccaacgacggcaccaagcgctaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17077 - RNA, 432 nt, synthetic construct
  misc_feature 1..432: note = derived and/or modified sequence opt2 from anti-HIV_cap256-119-141307_VR-Chain
  source 1..432: mol_type = other RNA
caggtccacctcgtcgagtccggcggcggcgtcgtccagcccggccgctccctccgcctctcctgcgccgcctcccagttcaccttcaaccgctacggcctccactgggtccgccaggcccccggcaagggcctcgagtgggtcgccggcatctcctacgacggccgcgacaagtaccacgcccacttcgtctggggccgcttcatcatctcccgcgacaactccaagaacaccctctacctccagatgaactccctccgcgccgaggacaccgccctctactactgcgtccgcgacctccgcgagtccgagtgcgagctctgggagtccgactactacgacttcggcaagcgcctcccctgcgtcaagccccgcggcgtcgccggcaccttcgacctctggggccagggcaccatggtcaccgtctcctcc

SEQ ID NO: 17078 - RNA, 432 nt, synthetic construct
  misc_feature 1..432: note = derived and/or modified sequence opt2 from anti-HIV_cap256-119-140896_VR-Chain
  source 1..432: mol_type = other RNA
gaggtcaagctcgtcgagtccggcggcggcctcgtccagcccggcggctccctcaagctctcctgcgccgcctccggcttcaccttctcctactacgccatgcactgggtccgccaggcccccggcaagggcctcgagtgggtcgccgtcatctcctacgacggctccgacaagtactacgccgactccgtcaagggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17079 - RNA, 432 nt, synthetic construct
  misc_feature 1..432: note = derived and/or modified sequence opt2 from anti-HIV_cap256-119-140090_VR-Chain
  source 1..432: mol_type = other RNA
gaggtccagctcgtcgagtccggcggcggcctcgtccagcccggcggctccctccgcctctcctgcgccgcctccggcttcgccttctcctcctactggatgacctgggtccgccaggcccccggcaagggcctcgagtgggtcgccgtcatctcctacgacggctccaacaagtactacgccgactccgtccgcggccgcttcaccatctcccgcgactcctccaagaacaccctctacctcgagatgaactccctccgccccgaggacaccgccctctactactgcgccaaggacatgcgcggctacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17080 - RNA, 438 nt, synthetic construct
  misc_feature 1..438: note = derived and/or modified sequence opt2 from anti-HIV_cap256-119-140037_VR-Chain
  source 1..438: mol_type = other RNA
caggtccagctcgtcgagtccggcggcggcctcgtccagcccggccgctccctccgcctctcctgcgccgcctccggcttcaccttcgacgactacgtcatgcactgggtccgccaggcccccggcaagggcctcgagtgggtcgcctccatctccaacgacggcaccaagaagtaccacgaggagtccgtctggggccgcttcaccatctccaaggacaactccaagtccaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17081 - RNA, 432 nt, synthetic construct
  misc_feature 1..432: note = derived and/or modified sequence opt2 from anti-HIV_cap256-119-139135_VR-Chain
  source 1..432: mol_type = other RNA
gaggtccagctcgtcgagtccggcggcggcgtcgtccgccccggcggctccgtccgcctctcctgcgtcgcctccggcttctccttccgctcctacggcatgcactgggtccgccaggcccccggcaagggcctcgagtgggtcgcctccatctcctacgacggccgcgacttctaccacgcccgctccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17082 - RNA, 438 nt, synthetic construct
  misc_feature 1..438: note = derived and/or modified sequence opt2 from anti-HIV_cap256-119-137881_VR-Chain
  source 1..438: mol_type = other RNA
caggtccagctcgtcgagtccggcggcggcctcgtcaagcccggccgctccctcaccctctcctgcgccgcctcccagttcaccttctccaactacggcatgcactgggtccgccaggcccccggcaagggcctcgagtgggtcgcctccatctccaacgacggcaacaagaagtaccacggcgactccgtctgggcccgcttcaccatctcccgcgacaactccaagaacaccctcttcctccagatgtcctccctccgcaccgaggacaccgccctctacttctgcgtccgcgaccgccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17083 - RNA, 432 nt, synthetic construct
  misc_feature 1..432: note = derived and/or modified sequence opt2 from anti-HIV_cap256-119-137643_VR-Chain
  source 1..432: mol_type = other RNA
gaggtccagctcgtcgagtccggcggcgacctcgtccagcccggcggctccctccgcctctcctgcgccgcctccggcttctccttctcctcctacggcatgcactgggtccgccaggcccccgacaagggcctcgagtgggtcaccgtcatctcctacgacggctccaacaagcactacgccgactccgtcaagggccgcttcaccatctcccgcgacaactccaagaacaccctctacctcgagatgaacaccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtctccgtctcctcc

SEQ ID NO: 17084 - RNA, 438 nt, synthetic construct
  misc_feature 1..438: note = derived and/or modified sequence opt2 from anti-HIV_cap256-119-137170_VR-Chain
  source 1..438: mol_type = other RNA
caggtccagctcgtcgagtccggcggcggcgtcgtccagcccggccgctccctccgcctctcctgcgccgcctccgagttcaccttctcccgctactccatgcactgggtccgccaggcccccggcaagggcctcgagtgggtcgccgtcatctcctccgacggctccaaccagttccacgccgactccgtctggggccgcttcaccatctccaaggacaactccaagaacaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17085 - RNA, 432 nt, synthetic construct
  misc_feature 1..432: note = derived and/or modified sequence opt2 from anti-HIV_cap256-119-136616_VR-Chain
  source 1..432: mol_type = other RNA
caggtccagctcgtcgagtccggcggcggcgtcgtccagcccggccgctccctccgcctctcctgcgccgcctccggcttcaccttctcccgcaacgccatcaactgggtccgccaggcccccggccgcggcctcgagtgggtcgccgtcatctccgacgacggctccctcaagtactacgccgactccgtcaagggccgcttcaccatctcccgcgacaactccaagaacaccctctacctccagatgaacaacctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17086 - RNA, 432 nt, synthetic construct
  misc_feature 1..432: note = derived and/or modified sequence opt2 from anti-HIV_cap256-119-136206_VR-Chain
  source 1..432: mol_type = other RNA
caggtccagctcgtcgagtccggcggcggcgtcgtccagcccggccgctccctccgcctctcctgcgccgcctcccagttcaccttcggccgctacggcatgcactgggtccgccaggcccccggcaagggcctcgagtgggtcgccgccatctccttcgccggcaccaagaagtactacggcgactccgcccgcggccgcttcaccatctcccgcgacaactccaagaacatgctcttcctccagatgaactccctccgcgccgaggacaccgccctctactactgcgcccgcgacctccgcgactacgagtgcgaggagtgggaggcctactactacgacttcggccgcgtcggcccctgcaccgacccccgcggcgtcgtcggcatcctcgacgtctggggccagggcaccctcgtcaccgtctcctcc

SEQ ID NO: 17087 - RNA, 438 nt, synthetic construct
  misc_feature 1..438: note = derived and/or modified sequence opt2 from anti-HIV_cap256-119-135565_VR-Chain
  source 1..438: mol_type = other RNA
caggtccacctcgtcgagtccggcggcggcgtcgtccagcccggcaagtccctccgcctctcctgcgccgcctcccagttcaccttcgaccgctacggcatgcactgggtccgccaggcccccggcaagggcctcgagtgggtcgcctccatctccaacgacggcaccgacaagtaccacgccgacaacgtctggggccgcttcaccatctcccgcgacaactccaagaacaccctctacctcgagatgaactccctccgcggcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17088 - RNA, 432 nt, synthetic construct
  misc_feature 1..432: note = derived and/or modified sequence opt2 from anti-HIV_cap256-119-135025_VR-Chain
  source 1..432: mol_type = other RNA
gaggtccagctcgtcgagtccggcggcggcctcgtccagcccggcggctccctccgcctctcctgcgaggcctccggcttcaccttcaacacctacgagatgaactgggtccgccagccccccggccgcggcctcgagtgggtcgccggcatctccttcgccgccaccaagacctactacggcggctccgtcaagggccgcttcaccgtctcccgcgacatctccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17089 - RNA, 432 nt, synthetic construct
  misc_feature 1..432: note = derived and/or modified sequence opt2 from anti-HIV_cap256-119-133983_VR-Chain
  source 1..432: mol_type = other RNA
cagatgcagctcgtcgagtccggcggcggcgtcgtccagcccggccgctccctcaccctctcctgcgccgcctcccagttcaacttcgccaactacggcatgcactgggtccgccaggcccccggcaagggcctcgagtgggtcgcctccatctccaacgacggcaccaagaagtaccacgaggagtccgtctggggccgcttcaccatctccaaggacaactccaagaacaccctcttcctccagatgaactccctccgccccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17090 - RNA, 438 nt, synthetic construct
  misc_feature 1..438: note = derived and/or modified sequence opt2 from anti-HIV_cap256-119-133917_VR-Chain
  source 1..438: mol_type = other RNA
cagatgcagctcgtcgagtccggcggcggcgtcgtccagcccggccgctccctcaccctctcctgcgccgcctcccagttcaccttctccaactacggcatgcactgggtccgccaggcccccggcaagggcctcgagtgggtcgcctccatctccaacgacggctccaagaagtaccacggcgactccgtctgggcccgcttcaccatctcccgcgacaactccaagaacaccctcttcctccagatgtcctccctccgcgtcgaggacaccgccctctacttctgcgtccgcgaccagcgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17091 - RNA, 432 nt, synthetic construct
  misc_feature 1..432: note = derived and/or modified sequence opt2 from anti-HIV_cap256-119-132663_VR-Chain
  source 1..432: mol_type = other RNA
caggcccagctcgtcgagtccggcggcggcgtcgtccagcccggccgctccctccgcatctcctgcgccgtctcccagttcaccttctcccgctacggcatgcactgggtccgccaggcccccggcaagggcctcgagtgggtcgcctccatctccttcgacggccgcgacaagtaccactcccccctcgtctggggccgcctcaccatctcccgcgacaactccaagaacaccctcttcctcgagatgaactccctccgcgccgaggacaccgccgtctactactgcgcccgcgacctccgcgagtccgagtgcgaggagtggcagtccgactactacgccttctacaagaagctcccctgcgtcaagccccgcggcgtcgccggctccctcgacatctggggccagggcaccgtcgtcaccgtctcctcc

SEQ ID NO: 17092 - RNA, 438 nt, synthetic construct
  misc_feature 1..438: note = derived and/or modified sequence opt2 from anti-HIV_cap256-119-132113_VR-Chain
  source 1..438: mol_type = other RNA
caggtccagctcgtcgagtccggcggcggcctcgtcaagcccggcggctccctccgcctctcctgcgccgcctcccagttcaacttcgccaactacggcatgcactgggtccgccaggcccccggcaagggcctcgagtgggtcgcctccatctccaacgacggcaccaagaagtaccacgaggagtccgtctggggccgcttcaccatctccaaggacaactccaagtccaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17093 - RNA, 432 nt, synthetic construct
  misc_feature 1..432: note = derived and/or modified sequence opt2 from anti-HIV_cap256-119-131839_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17094 - RNA, 435 nt, synthetic construct
  misc_feature 1..435: note = derived and/or modified sequence opt2 from anti-HIV_cap256-119-130626_VR-Chain
  source 1..435: mol_type = other RNA
gaggtccagctcgtcgagtccggcggcggcctcatccaccccggcggctgcctccgcctctcctgcgccgtctccggcttcaccttctccgactaccccatgcactgggtccgccagtcccccggcaagggcctcgagtgggtcgccgtcatctcctacgacggcatcaactactactacgccgactccgtcaagggccgcttcaccatctcccgcgacaactccaagaacaacctcttcctccagatgaactccctccgcctcgaggacaccgccctctactactgcgcccgcgacctccgcgagctcgactgcgaggagtggaccctctacaactactacgacttcggctcccgcggcccctgcgtcgacccccgcggcgtcggcggctccttcgacgtctggggccagggcaccatggtcaccgtctcctcc

SEQ ID NO: 17095 - RNA, 438 nt, synthetic construct
  misc_feature 1..438: note = derived and/or modified sequence opt2 from anti-HIV_cap256-119-130191_VR-Chain
  source 1..438: mol_type = other RNA
gaggtccagctcgtcgagtccggcggcggcctcatccagcccggccgctccctccgcctctcctgcgccgcctccggcttcaccgtctcctccaacttcatgacctgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17096 - RNA, 438 nt, synthetic construct
  misc_feature 1..438: note = derived and/or modified sequence opt2 from anti-HIV_cap256-119-129798_VR-Chain
  source 1..438: mol_type = other RNA
caggtccagctcgtcgagtccggcggcggcgtcgtccagcccggcaagtccctccgcctctcctgcgccgcctccggcttcatcttctcctcctacttcatgcactgggtccgccaggcccccggcaagggcctcgagtgggtcgccgtcgtcaccgacgacggctccaagaagtactacgccgactccgtcaagggccgcttcaccatctcccgcgactactccaagaacaccctcttcctccagatgaaccgcctccgcgtcgaggacaccgccctctacttctgcgtcaaggaccagcgcgaggacgagtgcgaggagtggtggtccgactactacgacttcggccgcgagctcccctgccgcaagttccgcggcctcggcctcgccggcatcttcgacatgtggggccacggcaccatggtcaccgtctcctcc

SEQ ID NO: 17097 - RNA, 432 nt, synthetic construct
  misc_feature 1..432: note = derived and/or modified sequence opt2 from anti-HIV_cap256-119-128745_VR-Chain
  source 1..432: mol_type = other RNA
caggtccagctcgtcgagtccggcggcggcgtcgtccagcccggccgctccctccgcctctcctgcgccgcctccggcttcaccttctccaactacgccatgcactgggtccgccaggcccccggcaagggcctcgagtgggtcgcctccatctccttcgccggcaccaagacccactacggcaactccgtcaagggccgcttctccatctcccgcgacaactccatcaacaccgtctacctccagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17098 - RNA, 438 nt, synthetic construct
  misc_feature 1..438: note = derived and/or modified sequence opt2 from anti-HIV_cap256-119-128593_VR-Chain
  source 1..438: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgcctccatctcctacgacggccgcgacttctaccacgcccgctccgtctggggccgcttcaccatctcccgcgacaactccaagaacaccctccacctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatctggggccacggcaccatggtcaccgtctcctcc

SEQ ID NO: 17099 - RNA, 438 nt, synthetic construct
  misc_feature 1..438: note = derived and/or modified sequence opt2 from anti-HIV_cap256-119-128152_VR-Chain
  source 1..438: mol_type = other RNA
caggtccagctcgtcgagtccggcggcggcgtcgtccagcccggccgctccctccgcctctcctgcgccgtctccggcttcaccttcacctcctaccccatgcactgggtccgccaggcccccggcaagggcctcgagtgggtcgcctccgtctccaacgacggcaccaagaagtaccacggcgactccgtctgggaccgcttcaccatctcccgcgacaactccaagaacaccctcttcctccagatgtcctccctccgcgccgaggacaccgccgtctacttctgcgtccgcgacgagcgcgaggacgagtgcgaggagtggtggtccgactactacgacttcggccgcgagctcccctgccgcaagttccgcggcctcggcctcgccggcatcttcgacatctggggccacggcaccctcgtcaccgtctcctcc

SEQ ID NO: 17100 - RNA, 438 nt, synthetic construct
  misc_feature 1..438: note = derived and/or modified sequence opt2 from anti-HIV_cap256-119-127693_VR-Chain
  source 1..438: mol_type = other RNA
gaggtccagctcctcgagtccggcggcggcctcgtccagcccggcggctccctccgcctctcctgcgccgcctccggcttcaccttctcctcctacgccatggcctgggtccgccaggcccccggcaagggcctcgagtgggtcgcctccatctccaacgacggctccaagaagtaccacggcgactccgtctgggcccgcttcatcatctcccgcgacaactccaagaacaccctcttcctccagatgtcctccctccgcgtcgaggacaccgccctctacttctgcgtccgcgaccaccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17101 - RNA, 432 nt, synthetic construct
  misc_feature 1..432: note = derived and/or modified sequence opt2 from anti-HIV_cap256-119-126684_VR-Chain
  source 1..432: mol_type = other RNA
caggtccagctcgtcgagtccggcggcggcgccgtccgccccggccgctccctccgcctctcctgcgccacctccggcttcaccttctccaactacgccatgcactgggtccgccaggcccccggcaagggcctcgagtgggtcaccggcatctccttcgccggcaccaagacctactacggcgactccgtccgcggccgcttcaccgtctcccgcgacatctccaagaacaccctcttcctccagatgaactccctccgccccgacgacaccgccatgtactactgcgcccgcgaccagcgctactacgagtgcgaggagtgggcctccgactactacgacttcggccgcgagcagccctgcctcgacccccgcggcgtcgtcggcatcttcgacctctggggccagggcaccatggtcaccgtctcctcc

SEQ ID NO: 17102 - RNA, 438 nt, synthetic construct
  misc_feature 1..438: note = derived and/or modified sequence opt2 from anti-HIV_cap256-119-126056_VR-Chain
  source 1..438: mol_type = other RNA
gaggtccagctcgtcgagtccggcggcggcctcgtccagcccggcggctccctccgcctctcctgcgccgactccggcttcaccttctcctcctactggatgtcctgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17103 - RNA, 432 nt, synthetic construct
  misc_feature 1..432: note = derived and/or modified sequence opt2 from anti-HIV_cap256-119-125765_VR-Chain
  source 1..432: mol_type = other RNA
caggtccagctcgtccagtccggcggcggcgtcgtccagcccggccgctccctccgcctctcctgcgccgcctccggcttcaccttctcctcctacgtcatgcactgggtccgccaggcccccggcaagggcctcgagggcgtcgccgtcatctccttcgacggcaacaacgagtactacgccgactccgtcaagggccgcttcaccatctcccgcgacaactccaagaacaccgtctacctccagatgaactccctccgcgtcgaggacaccgccctctactactgcgccaaggacatgcgcgagtacgagtgcgaggagtggacctccgactactacgacttcggccgcccccagccctgcatcgactcccgcggcgtcgtcggcatcctcgacatctggggccagggcatcatggtcaccgtctcctcc

SEQ ID NO: 17104 - RNA, 438 nt, synthetic construct
  misc_feature 1..438: note = derived and/or modified sequence opt2 from anti-HIV_cap256-119-125106_VR-Chain
  source 1..438: mol_type = other RNA
caggtccagctcgtcgagtccggcggcggcgtcgtccagcccggccgctccctccgcctctcctgcgccgcctccggcttcatcttccgctcctacggcatgcactgggtccgccaggcccccggcaagggcctcgagtgggtcgcctccatctccaacgacggcaccaagcgctaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17105 - RNA, 435 nt, synthetic construct
  misc_feature 1..435: note = derived and/or modified sequence opt2 from anti-HIV_cap256-119-124026_VR-Chain
  source 1..435: mol_type = other RNA
caggtccagctcgtcgagtccggcggcggcgtcgtccagtccggccgctccctccgcctcacctgctccggctccgccttccgcttctcctcctacaccgtccactgggtccgccaggcccccggcaagggcctcgagtggctcgccctcatctcctacgacggccagaagaagcacttcgccgactccgtcaagggccgcttcaccatctcccgcgacaactccaagaacaacctcttcctccagatgaactccctccgcctcgaggacaccgccctctactactgcgcccgcgacctccgcgagctcgactgcgaggagtggaccctctacaactactacgacttcggctcccgcggcccctgcgtcgacccccgcggcgtcggcggctccttcgacgtctggggccagggcaccatggtcaccgtctcctcc

SEQ ID NO: 17106 - RNA, 432 nt, synthetic construct
  misc_feature 1..432: note = derived and/or modified sequence opt2 from anti-HIV_cap256-119-121783_VR-Chain
  source 1..432: mol_type = other RNA
ctcggccgcctcgtcgcctccggcggcggcgtcgtcccccccggcggctccctcaccctctcctgcgtcacctcccagttcaccttctccggctgcggcctccactgggtccgccaggcccccggcaagggcctcgagtgggtcgcctccatctccttcgccggcaccaagaagcactacggctcctccgtccgcggccgcttctccatctcccgcgacaactccaagaacaccctctacctccagatgaactccctccgcaccgaggacaccgccctctacttctgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17107 - RNA, 432 nt, synthetic construct
  misc_feature 1..432: note = derived and/or modified sequence opt2 from anti-HIV_cap256-119-121208_VR-Chain
  source 1..432: mol_type = other RNA
ctcggccgcctcgtcgcctccggcggcggcgtcgtcccccccggcaagtccctcaccctctcctgcgtcgcctcccagttcaccttctccggctgcggcctccactgggtccgccaggcccccggcaagggcctcgagtgggtcgcctccatctccttcgccggcaccaagaagcactacggcaacttcgtccgcggccgcttcaccatctcccgcgacaactccaagaacaccctctacctccagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17108 - RNA, 432 nt, synthetic construct
  misc_feature 1..432: note = derived and/or modified sequence opt2 from anti-HIV_cap256-119-120945_VR-Chain
  source 1..432: mol_type = other RNA
caggtccagctcgtcgagtccggcggcggcgtcgtccagcccggcggctccctccgcctctcctgcgtcgcctccggcttcaccttctccaactacggcatgcactgggtccgccaggcccccggcaagggcctcgcctgggtcgccttcatccgctacgacggctccaacaagtactacgtcgactccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaacaagggcccctgcgtcaagccccgcggcgtcgtcggcgtcctcgacatctggggccagggcaccctcgtcaccgtctcctcc

SEQ ID NO: 17109 - RNA, 432 nt, synthetic construct
  misc_feature 1..432: note = derived and/or modified sequence opt2 from anti-HIV_cap256-119-118229_VR-Chain
  source 1..432: mol_type = other RNA
caggtccaggtcgtcgagtccggcggcggcgtcgtccagcccggccgctccctccgcctctcctgcgccgcctccggcttcaccttctccaactacgccatccactgggtccgccaggcccccggcaagggcctcgagtgggtcgccctcatctcctacgacggctacaacaagtactacgccgactccgtccgcggccgcttcaccatctcccgcgacaactccaacaacaccgtctacctccagatgaactccctcaagcccgaggacaccgccgtctactactgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17110 - RNA, 432 nt, synthetic construct
  misc_feature 1..432: note = derived and/or modified sequence opt2 from anti-HIV_cap256-119-118025_VR-Chain
  source 1..432: mol_type = other RNA
gaggtccagctcgtcgagtccggcggcggcgtcgtccagcccggcaagtccctccgcctctcctgcaccgcctcccagttcaccttctccaacttcggcatgcactgggtccgccaggcccccggcaagggcctcgagtgggtcgcctccatctccttcgtcggcatcaagacccactacgccaactccgtccgcggccgcttcaccatctcccgcgaccagtccaagaacaccctctacctccagatgaactccgtccgcatcgaggacaccgcccgctacttctgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17111 - RNA, 432 nt, synthetic construct
  misc_feature 1..432: note = derived and/or modified sequence opt2 from anti-HIV_cap256-119-117418_VR-Chain
  source 1..432: mol_type = other RNA
caggtccagctcgtcgagtccggcggcggcgtcgtccagcccggccgctccctccgcctctcctgcgccgcctccggcttcaacttccgcaactacgacatcaactgggtccgccaggtccccggcaagggcctcgagtgggtcgccgccatctccttcgacggcgccgacaagtaccacgccgacaacgtctggggccgcctctccatctcccgcgacaactccaagtccaccctctacctccagatgaactccctccgccccgaggacaccgccgtctacttctgcgccaaggacctccgcgaggacgagtgcgaggagcgctggtccgactactacgacttcggcaagcagctcccctgccgcaagtcccgcggcgtcgccggcatcttcgacaactggggccagggcaccatggtcaccgtctccgcc

SEQ ID NO: 17112 - RNA, 432 nt, synthetic construct
  misc_feature 1..432: note = derived and/or modified sequence opt2 from anti-HIV_cap256-119-117250_VR-Chain
  source 1..432: mol_type = other RNA
caggtccgcctcgtcgagtccggcggcggcgtcgtccagcccggcggctccctccgcctctcctgcgccgcctcccagttcaccttctccgcctacggcatgcactgggtccgccaggcccccggcaagggcctcgagtgggtcgcctccatctccttcgacggcaccgacaagttccacgccgacaaggtctggggccgcctcgtcatctcccgcgacaactccaagaacaccctctacctccagatgaactccctccgccccgaggacaccgccgtctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17113 - RNA, 432 nt, synthetic construct
  misc_feature 1..432: note = derived and/or modified sequence opt2 from anti-HIV_cap256-119-117230_VR-Chain
  source 1..432: mol_type = other RNA
caggtccagctcgtcgagtccggcggcggcggcgtccagcccggccgctccctccgcctctcctgcgccgcctccggcttcaccctctcctcctacggcatgcactgggtccgccaggcccccggcaagggcctcgagtgggtcgcctccatctccttcgacggccgcgactactaccactccccccacgtctggggccgcctcaccatctcccgcgacaactccaagaacaccctctacctccagatgaactccctccgcgccgaggacaccgccctctactactgcgcccgcgacctccgcgagtccgagtgcgaggagtgggagtccgactactacgacttcggcaagaagggcccctgcgtcaagccccgcggcgtcgccggctccctcgacatgtggggccagggcaccatggtcatcgtctcctcc

SEQ ID NO: 17114 - RNA, 432 nt, synthetic construct
  misc_feature 1..432: note = derived and/or modified sequence opt2 from anti-HIV_cap256-119-116999_VR-Chain
  source 1..432: mol_type = other RNA
caggtccagctcgtcgagtccggcggcggcgtcgtccagcccggcacctccctccgcatctcctgcgccgcctcccagttcaccttctcccgctacggcatgcactgggtccgccaggcccccggcaagggcctcgagtgggtcgcctccatctcctacgacggccgcgactactaccacgccggccgcgtctggggccgcttcaccatctcccgcgacaactccaagaacaccctctacctccagatgaactccctccgccccgaggacaccgccctctacttctgcgtccgcgactcccgcgagtccgagtgcgaggagtgggagtccgactactacgacttcggcaagaagctcccctgcgtcaagccccgcggcgtcgtcggcgtcctcgacctctggggccagggcaccctcgtcaccgtctcctcc

SEQ ID NO: 17115 - RNA, 432 nt, synthetic construct
  misc_feature 1..432: note = derived and/or modified sequence opt2 from anti-HIV_cap256-119-116558_VR-Chain
  source 1..432: mol_type = other RNA
caggtccagctcgtcgagtccggcggcggcgtcgtccagcccggccgctccctccgcctctcctgcgccgcctccggcttcaccttcaaccgctactccctccactgggtccgccaggcccccggcaagggcctcgagtgggtcgccttcacctcctacgacggctccaacaagtactaccccgactccgtcaagggccgcttcaccatctcccgcgactcctccaagaacaccctctacctcgagatgaactccctccgccccgaggacaccgccctctactactgcgccaaggacatgcgcggctacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17116 - RNA, 432 nt, synthetic construct
  misc_feature 1..432: note = derived and/or modified sequence opt2 from anti-HIV_cap256-119-116484_VR-Chain
  source 1..432: mol_type = other RNA
gacgtccagctcctcgagtccggcggcgacctcgtccagcccggcggctccctccgcctctcctgcgccgcctccggcttcaccttcaccaagtacgagatgacctgggtccgccaggcccccggcaagggcctcgagtgggtcgcctccatctcctacgacggctccgacaagtaccacacctcctccctctggggccgcttcatcgtctcccgcgacaactccaagaacaccctctacctccagatgaactccctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17117 - RNA, 438 nt, synthetic construct
  misc_feature 1..438: note = derived and/or modified sequence opt2 from anti-HIV_cap256-119-114844_VR-Chain
  source 1..438: mol_type = other RNA
gaggtccagctcgtcgagtccggcggcgacctcgtccagcccggccgctccctccgcctctcctgcgccgcctccggcttcaccttctcctcctactggatgtcctgggtccgccaggcccccggcaagggcctcgagtgggtcgcctccatctccaacgacggcaccaagaagtaccacgaggagtccgtctggggccgcttcaccatctccaaggacaactccaagtccaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17118 - RNA, 438 nt, synthetic construct
  misc_feature 1..438: note = derived and/or modified sequence opt2 from anti-HIV_cap256-119-114141_VR-Chain
  source 1..438: mol_type = other RNA
ggcggccgctccggcggcggcggcgtcggcaccaccccccgccgcggccccctccgcctctcctgcgccgcctccggcttcaccctcgacgactacgccatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgtcttctgggagcgcgccccctgccgcaccgtccccggccgcggccccggctggtacttcgacatggtcggccgccgcaccatggtcaccgtctcctcc

SEQ ID NO: 17119 - RNA, 432 nt, synthetic construct
  misc_feature 1..432: note = derived and/or modified sequence opt2 from anti-HIV_cap256-119-111917_VR-Chain
  source 1..432: mol_type = other RNA
gaggtccacctcgtcgagtccggcggcggcctcgtccagcccggcggctccctccgcctctcctgcgccgcctccggcttcaccttctcctcctacggcatgcactgggtccgccaggcccccggcaagggcctcgagtgggtcgccaccatctccttcgacggcgccgacaagtaccacgccgacgacgtctggggccgcttctccatctcccgcgacaactccaagaacaccctctacctccagatgaacaacctccgccccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17120 - RNA, 432 nt, synthetic construct
  misc_feature 1..432: note = derived and/or modified sequence opt2 from anti-HIV_cap256-119-111862_VR-Chain
  source 1..432: mol_type = other RNA
caggtccagctcgtcgagtccggcggcggcgtcgtccagcccggcggctccctccgcctctcctgcgccgcctccggcttcacctactccgactacggcatgcactgggtccgccaggcccccggcaagggcctcgagtgggtcgcctccatctccttcgccggcaccaagcagcactacggcaactccgtcaagggccgcttcaccatctcccgcgacaactccaagaacaccgtctacctccagatgaactccctccgcgtcgaggacaccgccctctactactgcgccaaggacatgcgcgagtacgagtgcgaggagtggacctccgactactacgacttcggccgcccccagccctgcatcgactcccgcggcgtcgtcggcatcctcgacatctggggccagggcatcatggtcaccgtctcctcc

SEQ ID NO: 17121 - RNA, 432 nt, synthetic construct
  misc_feature 1..432: note = derived and/or modified sequence opt2 from anti-HIV_cap256-119-110064_VR-Chain
  source 1..432: mol_type = other RNA
ctcggccgcctcgtcgcctccggcggcggcgtcgtcccccccggccgctccctccgcctctcctgcgtcgcctcccagttcaccttctccggctgcggcctccactgggtccgccaggcccccggcaagggcctcgagtgggtcgcctccatctccttcgccggcaccaagcagcactacggcaactccgtcaagggccgcttcaccatctcccgcgacaactccaagaacaccgtctacctccagatgaactccctccgcgtcgaggacaccgccctctactactgcgccaaggacatgcgcgagtacgagtgcgaggagtggacctccgactactacgacttcggccgcccccagccctgcatcgactcccgcggcgtcgtcggcatcctcgacatctggggccagggcaccatggtcaccgtctccttc

SEQ ID NO: 17122 - RNA, 432 nt, synthetic construct
  misc_feature 1..432: note = derived and/or modified sequence opt2 from anti-HIV_cap256-119-109192_VR-Chain
  source 1..432: mol_type = other RNA
caggtccagctcgtcgagtccggcggcggcgtcgtccagcccggccgctccctccgcctctcctgcgccgcctccggcttcaccttctccaactacgccatgcactgggtccgccaggcccccggcaagggcctcgagtgggtcgccgtcatcgcctacgacggcgacaacaagtactacgccgactccgtcaagggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacctcggcaagcagctcccctgccgcaagtcccgcggcgtcgccggcgtcctcgacaagtggggcctcggcaccatggtcaccgtctcctcc

SEQ ID NO: 17123 - RNA, 435 nt, synthetic construct
  misc_feature 1..435: note = derived and/or modified sequence opt2 from anti-HIV_cap256-119-108793_VR-Chain
  source 1..435: mol_type = other RNA
cagttccagctcgtcgagtccggcggcggcgtcgtccagcccggccgctccctccgcctctcctgcgccgcctccggcttcaccttctcctcctaccccatgcactgggtccgccaggcccccggcaagggcctcgagtgggtcgccctcatctcctacgacggcaccgacaagtactacgccgactccgtcaagggccgcttcaccatctcccgcgacaactccaagaacaccctctacctccagatgaactccctccgcgtcgaggacaccgccgtctaccactgcgccaaggacctcggcggctccaagtccgacgagtgggccaccgactactactacgactggtccaaggcctaccccgtccacgacccccgcgccgtcgtcggcgtcttcgacatctggggccagggcaccctcgtcaccgtctcctcc

SEQ ID NO: 17124 - RNA, 432 nt, synthetic construct
  misc_feature 1..432: note = derived and/or modified sequence opt2 from anti-HIV_cap256-119-108127_VR-Chain
  source 1..432: mol_type = other RNA
caggtccagctcgtcgagtccggcggcggcgtcgtccagcccggccgctccctccgcatctcctgcgccgcctcccagttcaccttcaaccgctacggcatgcactgggtccgccaggcccccggcaagggcctcgagtgggtcgcctccatctcctacgacggctccgacaagtaccacgccggcctcgtctggggccgcttcatcatctcccgcgacaactccaagaacaccctctacctccagatgaactccctccgcgccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17125 - RNA, 438 nt, synthetic construct
  misc_feature 1..438: note = derived and/or modified sequence opt2 from anti-HIV_cap256-119-107758_VR-Chain
  source 1..438: mol_type = other RNA
gaggtccagctcgtcgagtccggcggcggcctcgtcaagcccggcggctccctccgcctctcctgcgccgcctccggcttcaccttctccaacgcctggatgtcctgggtccgccaggcccccggcaagggcctcgagtgggtcgcctccatctccaacgacggcaccaagaagtaccacgaggagtccgtctggggccgcttcaccatctccaaggacaactccaagaacaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17126 - RNA, 432 nt, synthetic construct
  misc_feature 1..432: note = derived and/or modified sequence opt2 from anti-HIV_cap256-119-107209_VR-Chain
  source 1..432: mol_type = other RNA
gaggtccagctcgtcgagtccggcggcggcctcgtccagcccggccgctccctccgcctctcctgcaccgcctccggcttcaccttcggcgactacggcatgcactgggtccgccaggcccccggcaagggcctcgagtgggtcgccgccatctccttcgacggcgccgacaagtaccacgccgacaacgtctggggccgcctctccatctcccgcgacaactccaagtccaccctctacctccagatgaactccctccgccccgaggacaccgccgtctacttctgcgccaaggacctccgcgaggacgagtgcgaggagcgctggtccgactactacgacttcggcaagcagctcccctgccgcaagtcccgcggcgtcgccggcatcttcgacaactggggccagggcaccatggtcaccgtctccgcc

SEQ ID NO: 17127 - RNA, 432 nt, synthetic construct
  misc_feature 1..432: note = derived and/or modified sequence opt2 from anti-HIV_cap256-119-107184_VR-Chain
  source 1..432: mol_type = other RNA
caggcccagctcgtcgagtccggcggcggcgtcgtccagcccggccgctccctcggcctctcctgcgccgcctccaagttctccctctcctcctacggcatgcactgggtccgccaggcccccggccgcggcctcgagtgggtcgccggcatctccttcgccggcaccaagaagtactacgccgactccgtccgcggccgcttctccgtctccaccgacatctccaagaacaccctctacctccagatgaactccctccgccccgccgacaccgccctctacttctgcgcccgcgacctccgctactacgagtgcgaggagtgggcctccgactactacgacttcggcaaggagcagccctgcctcgacccccgcggcgtcgtcggcatcttcgacctctggggccagggcaccatggtcaccgtctcctcc

SEQ ID NO: 17128 - RNA, 438 nt, synthetic construct
  misc_feature 1..438: note = derived and/or modified sequence opt2 from anti-HIV_cap256-119-106827_VR-Chain
  source 1..438: mol_type = other RNA
gccgtccagctcgtcgagtccggcggcggcctcgtccagcccggcggctccctccgcctctcctgctccgtctcccagttcaccttcggccgctacggcatgtactgggtccgccaggcccccggcaagggcctcgagtgggtcgccgtcatctcctacgacggcggcaaccgctactacgccgactccgtcaagaaccgcttctccatctcccgcgacaactccaagaacaccctcttcctccagatgtcctccctccgcgccgaggacaccgccctctacttctgcgtccgcgaccaccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17129 - RNA, 432 nt, synthetic construct
  misc_feature 1..432: note = derived and/or modified sequence opt2 from anti-HIV_cap256-119-106511_VR-Chain
  source 1..432: mol_type = other RNA
caggtccagctcgtcgagtccggcggcggcgtcgtccagcccggccgctccctccgcctctcctgcgtcgcctcccagttctccttcgaccgctacggcatgcactgggtccgccaggcccccggcaagggcctcgagtgggtcgcctccatctccttcgacggcaccgacaagtaccacgccgacaaggtctggggccgcttcaccatctcccgcgacaactccaagaacaccctctacctccagatgaactccctccgccccgaggacaccgccctctactactgcgccaaggacatgcgcgaggacgagtgcgaggcctggtggtccgactactacgacctcggcaagcagctcccctgccgcgagtcccgcggcgtcgccggcatcttcgacgagtggggccagggcaccatggtcaccgtctcctcc

SEQ ID NO: 17130 - RNA, 432 nt, synthetic construct
  misc_feature 1..432: note = derived and/or modified sequence opt2 from anti-HIV_cap256-119-106327_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgccatctccggcggcggcggcaacacctacgtcgccgactccgtcaagggccgcttcaccatctcccgcgacaactccaagaacaccgtctacctccagatgaactccctccgcctcgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17131 - RNA, 438 nt, synthetic construct
  misc_feature 1..438: note = derived and/or modified sequence opt2 from anti-HIV_cap256-119-105486_VR-Chain
  source 1..438: mol_type = other RNA
caggtccagctcgtcgagtccggcggcggcgtcgtccagcccggcggctccctccgcctctcctgcgccgcctccggcttcaccgtctccggctacggcatgcactgggtccgccaggcccccgccaagggcctcgactgggtcgccttcatctcccacgacggctccaacaagtactacgccgactccgtccgcggccgcttcatcatctcccgcgacaactccaacaacaccctctacgtccagatgtcctccctccgcgccgaggacaccgccctctacttctgcgtccgcgaccaccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17132 - RNA, 432 nt, synthetic construct
  misc_feature 1..432: note = derived and/or modified sequence opt2 from anti-HIV_cap256-119-105197_VR-Chain
  source 1..432: mol_type = other RNA
caggtccagctcgtcgagtccggcggcggcgtcgtccagcccggccgctccctccgcctctcctgcgccgtctcccagttcaccttcggccgctacggcatgcactgggtccgccaggcccccggcaagggcctcgagtgggtcggctccatctcctacgacggctccgacaagtaccacaccaactccctctggggccgcttcatcgtctcccgcgacaactccaagaacaccctctacctccagatgaacaacctccgccccgaggacaccgccctctactactgcgtccgcgaccgccgcgagtccgagtgcgaggagcgctggtccgactactacgacttcggcaagcagctcccctgcgtcaagccccgcggcgtcgtcggcgtcctcgacatctggggccagggcaccctcgtcaccgtctcctcc

SEQ ID NO: 17133 - RNA, 432 nt, synthetic construct
  misc_feature 1..432: note = derived and/or modified sequence opt2 from anti-HIV_cap256-119-104946_VR-Chain
  source 1..432: mol_type = other RNA
caggagcagctcgtcgagtccggcggcggcgtcgtccagcccggccgctccctccgcctctcctgcgtcgcctcccgcttcaccttctccgccttcggcatgcactgggtccgccaggcccccggcaagggcctcgagtgggtcgcctccatctccttcgccggcatcaagaagtactacggcgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcatcgactcccgcggcgtcgtcggcatcctcgacatctggggccagggcatcatggtcaccgtctcctcc

SEQ ID NO: 17134 - RNA, 432 nt, synthetic construct
  misc_feature 1..432: note = derived and/or modified sequence opt2 from anti-HIV_cap256-119-103667_VR-Chain
  source 1..432: mol_type = other RNA
caggtccacctcgtcgagtccggcggcggcgtcgtccagcccggcaagtccctccgcctctcctgcgccgcctcccagttcaccttcaaccgcttcggcatgcactgggtccgccaggcccccggcaagggcctcgagtgggtcgccggcatctcctacgacggctccgacaagtaccacgccgacaaggtctggggccgcttcaccatctcccgcgacaactccaagaacaccctctacctccagatgaactccctccgcgccgaggacaccgccctctactactgcgccaaggacctccgcgaggacgagtgcgaggagtgggcctccgactactacgacttcggcaaggagcagccctgcctcgacccccgcggcgtcgtcggcatcttcgacatctggggccagggcaccatggtcaccgtctcctcc

SEQ ID NO: 17135 - RNA, 438 nt, synthetic construct
  misc_feature 1..438: note = derived and/or modified sequence opt2 from anti-HIV_cap256-119-103385_VR-Chain
  source 1..438: mol_type = other RNA
gaggtccagctcgtcgagtccggcggcggcctcgtccagaccggcggctccctccgcctctcctgcgccgcctccggcttcaccttctcccgctacgacatgaactgggtccgccaggcccccggcaagggcctcgagtgggtcgcctccatctccaacgacggctccaagaagtaccacggcgactccgtctgggcccgcttcaccatctcccgcgacaactccaagaacaccctcttcctccagatgtcctccctccgcgtcgaggacaccgccctctacttctgcgtccgcgaccagcgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17136 - RNA, 438 nt, synthetic construct
  misc_feature 1..438: note = derived and/or modified sequence opt2 from anti-HIV_cap256-119-103267_VR-Chain
  source 1..438: mol_type = other RNA
gaggtcccctccgtcgagtccggcggcggcctcgtccagaccggcggctccctcaccctctcctgcgccgcctcccagttcaccttctccaactacggcatgcactgggtccgccaggcccccggcaagggcctcgagtgggtcgcctccatctccaacgacggctccaagaagtaccacggcgactccgtctgggcccgcttcatcatctcccgcgacaactccaagaacaccctcttcctccagatgtcctccctccgcgccgaggacaccgccctctacttctgcgtccgcgaccaccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17137 - RNA, 432 nt, synthetic construct
  misc_feature 1..432: note = derived and/or modified sequence opt2 from anti-HIV_cap256-119-103011_VR-Chain
  source 1..432: mol_type = other RNA
caggtccagctcgtcgagtccggcggcggcgtcgtccagcccggcggctccctccgcctctcctgcgccacctccggcttcaccttcggcaccttcggcatgcactgggtccgccaggcccccggcaagggcctcgactgggtcgccgccatctccttcgccggcaccaagaagaactacgccgactccgtccgcggccgcttcaccatctcccgcgactcctccaagaacaccctctacctccagatgaactccctccgccccgaggacaccgccctctactactgcgtcaaggacatgcgcggctacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17138 - RNA, 438 nt, synthetic construct
  misc_feature 1..438: note = derived and/or modified sequence opt2 from anti-HIV_cap256-119-102072_VR-Chain
  source 1..438: mol_type = other RNA
gaggtccagctcgtcgagtccggcggcggcctcgtccagcccggcggctccctccgcgtctcctgcgccgtctccggcttcaccttctccaactacgagatgaactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatctggggccacggcaccatggtcaccgtctcctcc

SEQ ID NO: 17139 - RNA, 438 nt, synthetic construct
  misc_feature 1..438: note = derived and/or modified sequence opt2 from anti-HIV_cap256-119-101945_VR-Chain
  source 1..438: mol_type = other RNA
gaggtccagctcgtcgagtccggcggcggcctcgtccagcccggcggctccctccgcctctcctgcgccgcctccggcttcaccttctcctcctacgtcatgcactgggtccgccaggcccccggcaagggcctcgagtgggtcgcctccatctccaacgacggcaccaagaagtaccacgaggagtccgtctggggccgcttcaccatctccaaggacaactccaagaacaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17140 - RNA, 432 nt, synthetic construct
  misc_feature 1..432: note = derived and/or modified sequence opt2 from anti-HIV_cap256-119-101319_VR-Chain
  source 1..432: mol_type = other RNA
caggtccagctcgtcgagtccggcggcggcgtcgtccagcccggcaagtccctccgcctctcctgcgtcggctccggcttcaccttcgacgactacggcatgcactgggtccgccaggcccccggcaagggcctcgagtgggtcgcctccatctcctacgacggccgcgacttctaccacgcccgctccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17141 - RNA, 432 nt, synthetic construct
  misc_feature 1..432: note = derived and/or modified sequence opt2 from anti-HIV_cap256-119-100871_VR-Chain
  source 1..432: mol_type = other RNA
caggtccagctcgtcgagtccggcggcggcgtcgtccagcccggcgagtccctccgcatctcctgcgccgcctcccagttcaccttctcccgctacggcatgcactgggtccgccaggcccccggcaagggcctcgagtgggtcgcctccatctccttcgacggccgcgacaagtaccactcctccctcgtctggggccgcctcaccatctcccgcgacaactccaagtccaccctcttcctccagatgaactccctccgcgccgaggacaccgccctctactactgcgcccgcgacctccgcgagtccgagtgcgaggagtgggagtccgactactacgacttcggcaagccccagccctgcgaggacccccgcggcgtcgtcggcaccttcgacatgtggggcctcggcaccctcgtcaccgtctcctcc

SEQ ID NO: 17142 - RNA, 432 nt, synthetic construct
  misc_feature 1..432: note = derived and/or modified sequence opt2 from anti-HIV_cap256-119-100838_VR-Chain
  source 1..432: mol_type = other RNA
gaggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcatccgctacgacggctccaacaagtactacgccgactccgtcaagggccgcttcaccatctcccgcgacaactccaaccacaccctctacatgcagctcgactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17143 - RNA, 438 nt, synthetic construct
  misc_feature 1..438: note = derived and/or modified sequence opt2 from anti-HIV_cap256-119-100025_VR-Chain
  source 1..438: mol_type = other RNA
caggtccagctcgtcgagtccggcggcggcgtcgtccagcccggccgctccctccgcctctcctgcgccgcctccgtcttcaccttctcctactacggcatgcactgggtccgccaggcccccggcaagggcctcgagtgggtcgccttcatctcccacgacggctccaacaagtactacgccgactccgtccgcggccgcttcatcatctcccgcgacaactccaacaacaccctctacgtccagatgaactccctccgcgccgaggacaccgccctctacttctgcgtcaaggaccagcgcgaggacgagtgcgaggagtggtggtccgactactacgacttcggccgcgagctcccctgccgcaagttccgcggcctcggcctcgccggcaccttcgacatctggggccacggcaccatgctcatcgtctcctcc

SEQ ID NO: 17144 - RNA, 432 nt, synthetic construct
  misc_feature 1..432: note = derived and/or modified sequence opt2 from anti-HIV_cap256-119-100000_VR-Chain
  source 1..432: mol_type = other RNA
cagatgcagctcgtcgagtccggcggcggcgtcgtccagcccggccgctccctcaccctctcctgcgccgcctcccagttcaccttctccaactacggcatgcactgggtccgccaggcccccggcaagggcctcgagtgggtcgcctccatctccaacgacggcaacaagaagtaccacggcgactccgtctgggcccgcttcaccatctcccgcgacaactccaagaacaccctcttcctccagatgtcctccctccgcaccgaggacaccgccctctacttctgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17145 - RNA, 432 nt, synthetic construct
  misc_feature 1..432: note = derived and/or modified sequence opt2 from anti-HIV_cap256-119-098890_VR-Chain
  source 1..432: mol_type = other RNA
caggtccagctcgtcgagtccggcggcggcgtcgtccagcccggcgagtccctccgcatctcctgcgtcgcctcccagttcaccttcggccgctacggcatgcactgggtccgccaggcccccggcaagggcctcgagtgggtcgcctccatctccttcgacggccgcgacaagtaccactcccccctcgtctggggccgcctcaccatctcccgcgacaactccaagaacaccctcttcctccagatgaactccctccgcaccgaggacaccgccctctactactgcgcccgcgacctccgcgagtccgagtgcgaggagtgggagtccgactactacgccttctggcgcaagctcccctgcgtcaagccccgcggcgtcgccggcaccctcgacatctggggccagggcaccatggtctccgtctcctcc

SEQ ID NO: 17146 - RNA, 435 nt, synthetic construct
  misc_feature 1..435: note = derived and/or modified sequence opt2 from anti-HIV_cap256-119-098715_VR-Chain
  source 1..435: mol_type = other RNA
caggtccagctcgtcgagtccggcggcggcgtcgtccagcccggccgctccctccgcctctcctgcgccgcctccggcttctccttcaacaaccacggcatgcactgggtccgccaggcccccggcaagggcctcgagtgggtcgccggcatctccttcgccggcatcaagaagtactacggcacctccgtcaagggccgcttcaccatctcccgcgacaactccaagaacaacctcttcctccagatgaactccctccgcgtcgaggacaccgccctctactactgcgcccgcgacctccgcgagatggagtgcgaggagtggaccctctacaactactacgacttcggctcccgcggcccctgcgtcgacccccgcggcgtcgtcggctccttcgacgtctggggccagggcaccatggtcaccgtctcctcc

SEQ ID NO: 17147 - RNA, 438 nt, synthetic construct
  misc_feature 1..438: note = derived and/or modified sequence opt2 from anti-HIV_cap256-119-098632_VR-Chain
  source 1..438: mol_type = other RNA
cagatgcagctcgtcgagtccggcggcggcgtcgtccagcccggccgctccctcaccctctcctgcgccgcctcccagttcaacttcgccaactacgacatgcactgggtccgccaggcccccggcaagggcctcgagtgggtcgccttcatccgctacgacggcaacaacaagtactacgccgactccgtcaagggccgcttcaccatctcccgcgacaactccaagtccaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17148 - RNA, 432 nt, synthetic construct
  misc_feature 1..432: note = derived and/or modified sequence opt2 from anti-HIV_cap256-119-097199_VR-Chain
  source 1..432: mol_type = other RNA
caggtccagctcgtcgagtccggcggcggcgtcgtccagcccggccgctccctccgcctctcctgcgccgcctccggcttcgccttctcctcctacgccttccactgggtccgccaggcccccggcaagggcctcgagtgggtcgcctacatccccttccacggcaaccagcagtactacggcgactccgtcaagggccgcttcaccatctcccgcgacaactcccgcgacaccctcttcctcgagatgaactccctccgccccgaggacaccgccctctacttctgcgcccgcgaccagcgctactacgagtgcgaggagtgggcctccgactactacgacttcggccgcgagcagccctgcctcgacccccgcggcgtcgtcggcatcttcgacctctggggccagggcaccatggtcaccgtctcctcc

SEQ ID NO: 17149 - RNA, 432 nt, synthetic construct
  misc_feature 1..432: note = derived and/or modified sequence opt2 from anti-HIV_cap256-119-096189_VR-Chain
  source 1..432: mol_type = other RNA
caggtccagctcgtcgagtccggcggcggcgtcgtccagcccggccgctccctccgcctctcctgcgccgcctccggcttcaagttcggctccttcggcatgcactgggtccgccaggcccccggcaagggcctcgagtgggtcgccgtcatctcctacgacggctccgacaagtactacggctcctccgtccgcggccgcttctccatctcccgcgacaactccaagaacaccctctacctccagatgaactccctccgcaccgaggacaccgccctctacttctgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17150 - RNA, 432 nt, synthetic construct
  misc_feature 1..432: note = derived and/or modified sequence opt2 from anti-HIV_cap256-119-094581_VR-Chain
  source 1..432: mol_type = other RNA
caggtccacctcgtcgagtccggcggcggcgtcgtccagcccggccgctccctccgcctctcctgcgccgcctccggcttcaacttctccaactacgccatccactgggtccgccagacccccggcaagggcctcgagtgggtcaccctcatctccaacgacggctccaacaagtactacgccgactccctcaagggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggcaagcagctcccctgccgcaagtcccgcggcgtcgccggcatcttcgacggctggggccagggcaccatggtcaccgtctcctcc

SEQ ID NO: 17151 - RNA, 432 nt, synthetic construct
  misc_feature 1..432: note = derived and/or modified sequence opt2 from anti-HIV_cap256-119-094200_VR-Chain
  source 1..432: mol_type = other RNA
gaggtccagctcgtcgagtccggcggcggcctcgtccagcccggcggctccctccgcctctcctgcgccgcctccggcttcatcttctcctcctacgccctccactgggtccgccaggcccccggcaagggcctcgagtgggtcgcctccatctccttcgccggcaccaagaaccactacggcaactccgtcaagggccgcttcaccatctcccgcgacaactccaagaacaccgtctacctccagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17152 - RNA, 432 nt, synthetic construct
  misc_feature 1..432: note = derived and/or modified sequence opt2 from anti-HIV_cap256-119-094158_VR-Chain
  source 1..432: mol_type = other RNA
cagatgcagctcgtcgagtccggcggcggcgtcgtccagcccggctcctccctcaccctctcctgcgccgcctcccagttcaccttctccaactacggcatgcactgggtccgccaggcccccggcaagggcctcgagtgggtcgcctccatctccaacgacggcaccaagaagtaccacggcgactccgtctgggaccgcttcaccatctcccgcgacaactccaagaacaccctcttcctccagatgaactccctccgcgccgaggacaccgccctctacttctgcgtcaaggaccagcgcgaggacgagtgcgaggagtggtggtccgactactacgacttcggcaagcagctcccctgccgcaagtcccgcggcgtcgccggcatcttcgactcctggggccagggcaccatggtcaccgtctcctcc

SEQ ID NO: 17153 - RNA, 432 nt, synthetic construct
  misc_feature 1..432: note = derived and/or modified sequence opt2 from anti-HIV_cap256-119-092814_VR-Chain
  source 1..432: mol_type = other RNA
caggtccagctcgtcgagttcggcggcggcgtcgtccagcccggcggctccctccgcctctcctgcgccgcctccggcttctacttcaccgactacggcatgcactgggtccgccaggcccccggcgagggcctccagtgggtcgccttcatctcctacgacggcaacaccaagaccaccgccgactccgtccgcggccgcttcaccctctcccgcgacaactccaagaacaccctctacctccagatgaactccgtccgcgtcgaggacaccgcccgctacttctgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17154 - RNA, 432 nt, synthetic construct
  misc_feature 1..432: note = derived and/or modified sequence opt2 from anti-HIV_cap256-119-092808_VR-Chain
  source 1..432: mol_type = other RNA
caggtccagctcgtcgagtccggcggcggcgtcgtccagcccggccgctccctccgcctctcctgcgccgcctcccagttctccttcggcaactacggcatgcactgggtccgccaggcccccggcaagggcctcgagtgggtcgccgccatctccttcgccggcaccaagaccaactacgccgactccgtcaagggccgcttcaccatctcccgcgacaactccaagaacaccgtctacctccagatgaactccctccgcgccgaggacaccgccctctacttctgcgccaaggacatccgcgagtacgagtgcgagtactggacctccgactactacgacttcggccgcccccagccctgcatcgactcccgcggcgtcgtcggcaccttcgacgtctggggccagggcaccatggtcaccgtctcctcc

SEQ ID NO: 17155 - RNA, 432 nt, synthetic construct
  misc_feature 1..432: note = derived and/or modified sequence opt2 from anti-HIV_cap256-119-092573_VR-Chain
  source 1..432: mol_type = other RNA
caggagcagctcgtcgagtccggcggcggcgtcgtccagcccggcacctccctccgcctctcctgctccgcctccggcttcaccttctccaacttcgccatgaactgggtccgccaggcccccggcaagggcctcgagtgggtctccttcatctcctccgacggcaagaacaagaactacgtcgactccgtcaagggccgcttcaccatctcccgcgacaactacaagaacaccctctacctccagatgaactccctccgcaccgaggacaccgccgtctactactgcgccaaggacctcggcggcaccaaggacgacgagtgggccaccgactactacgactggtccaccgcctaccccgtccaggacccccgcgccgtcgccggcggcttcgacctctggggcctcggcaccatggtcaccgtctcctcc

SEQ ID NO: 17156 - RNA, 432 nt, synthetic construct
  misc_feature 1..432: note = derived and/or modified sequence opt2 from anti-HIV_cap256-119-090815_VR-Chain
  source 1..432: mol_type = other RNA
caggtccagctcgtcgagtccggcggcggcgtcgtcgagcccggccgctccctccgcctctcctgcgccgcctcccagttctccttctcctcctacggcatgcactgggtccgccaggcccccggcaagggcctcgagtgggtcgccgccatctccttcgacggcgccgacaagtaccacgccgacaacgtctggggccgcctctccatctcccgcgacaactccaagtccaccctctacctccagatgaactccctccgccccgaggacaccgccgtctacttctgcgccaaggacctccgcgaggacgagtgcgaggagcgctggtccgactactacgacttcggcaagcagctcccctgccgcaagtcccgcggcgtcgccggcatcttcgacaactggggccagggcaccatggtcaccgtctccgcc

SEQ ID NO: 17157 - RNA, 438 nt, synthetic construct
  misc_feature 1..438: note = derived and/or modified sequence opt2 from anti-HIV_cap256-119-090368_VR-Chain
  source 1..438: mol_type = other RNA
caggtccagctcgtcgagtccggcggcggcgtcgtccagcccggccgctccctccgcctctcctgcgccgcctccggcttcgccttctcccactacggcatcttctgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17158 - RNA, 432 nt, synthetic construct
  misc_feature 1..432: note = derived and/or modified sequence opt2 from anti-HIV_cap256-119-089710_VR-Chain
  source 1..432: mol_type = other RNA
caggtccagctcgtcgagtccggcggcggcgtcgtccagcccggccgctccctccgcctctcctgcaccgcctccggcttcggcttctccaactacgccatgcactgggtccgcctcgcccccggcaagggcctcgagtgggtcgcctccatctcctacgacggccgcgactaccaccacgccggcgccgtctggggccgcttcatcatctcccgcgacaactccaagaactccctccacctccagatgaactccctccgccccgaggacaccgccctctacttctgcgcccgcgacctccgcgagtccgagtgcgaggagtgggagtccgactactacaacttctggaagaagctcccctgcgtcaagccccgcggcgtcgtcggcatcctcgacatctggggccagggcaccgtcgtcaccgtctcctcc

SEQ ID NO: 17159 - RNA, 432 nt, synthetic construct
  misc_feature 1..432: note = derived and/or modified sequence opt2 from anti-HIV_cap256-119-088555_VR-Chain
  source 1..432: mol_type = other RNA
caggtccagctcgtcgagtccggcggcggcgtcgtccaggccggccgctccctccgcctctcctgcgccgcctcccagttcaccttctcccgctacggcatgcactgggtccgccaggcccccggcaagggcctcgagtgggtcgccggcatctcctacgacggccgcgacaagtaccacgcccacttcgtctggggccgcttcatcatctcccgcgacaactccaagaacaccctctacctccagatgaactccctccgcgccgaggacaccgccctctactactgcgtccgcgacctccgcgagtccgagtgcgagctctgggagtccgactactacgacttcggcaagcgcctcccctgcgtcaagccccgcggcgtcgccggcaccttcgacctctggggccagggcaccatggtcaccgtctcctcc

SEQ ID NO: 17160 - RNA, 432 nt, synthetic construct
  misc_feature 1..432: note = derived and/or modified sequence opt2 from anti-HIV_cap256-119-087962_VR-Chain
  source 1..432: mol_type = other RNA
gagatgcagctcgtcgagtccggcggcggcctcgtcaagcccggccgctccctccgcctctcctgcgccgcctccggcttcaccttctcctcctacgccatccactgggtccgccaggcccccggcaagggcctcgagtgggtcgccgtcatctcctacgacggctccaacaagtactacgccgactccgtcaagggccgcttcaccatctcccgcgacaactccaagaacaccgtctacctccagatgaactccctccgcgtcgaggacaccgccctctactactgcgccaaggacctccgcgagtacgagtgcgaggagtggacctccgactactacgacttcggcaagccccagccctgcatcgactcccgcggcgtcgtcggcatcctcgacatctggggccagggcatcatggtcaccgtctcctcc

SEQ ID NO: 17161 - RNA, 432 nt, synthetic construct
  misc_feature 1..432: note = derived and/or modified sequence opt2 from anti-HIV_cap256-119-086903_VR-Chain
  source 1..432: mol_type = other RNA
caggtccacctcgtcgagtccggcggcggcgtcgtccagcccggcaagtccctccgcctctcctgcgccgcctcccagttcaccttcgaccgctacggcatgcactgggtccgccaggcccccggcaagggcctcgagtgggtcgcctccatctccaacgacggcaccgacaagtaccacgccgacaacgtctggggccgcttcaccatctcccgcgacaactccaagaacaccctctacctcgagatgaactccctccgcggcgaggacaccgccctctactactgcgccaaggacatgcgcgaggacgagtgcgaggagtggtggtccgactactacgacttcggccgcccccagccctgcatcgactcccgcggcgtcgtcggcaccttccacgtctggggccagggcaccatggtcaccgtctcctcc

SEQ ID NO: 17162 - RNA, 432 nt, synthetic construct
  misc_feature 1..432: note = derived and/or modified sequence opt2 from anti-HIV_cap256-119-086804_VR-Chain
  source 1..432: mol_type = other RNA
gaggtccagctcgtcgagtccggcggcggcgtcgtccagcccggccgctccctccgcctcttctgcgccggctccggcttcaccttctcctcctacggcctccactgggtccgccaggcccccggcaagggcctcgagtgggtctccttcatctcctacgacggctccaccaccaagtacgccgactccctcaagggccgcttcaccgtctcccgcgacaactccaagaacaccgtctacctcgagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17163 - RNA, 432 nt, synthetic construct
  misc_feature 1..432: note = derived and/or modified sequence opt2 from anti-HIV_cap256-119-085910_VR-Chain
  source 1..432: mol_type = other RNA
gaggtccagctcctcgagtccggcggcggcctcgtccagcccggcggctccctccgcctctcctgcgccgcctccggcttcaccttctcctcctacggcatgcactgggtccgccaggccgccggcaagggcctcgagtgggtcgcctccatctcctacgacggccgcgactaccaccacgccggcgccgtctggggccgcttcatcatctcccgcgacaactccaagaactccctccacctccagatgaactccctccgccccgaggacaccgccctctacttctgcgcccgcgacctccgcgagtccgagtgcgaggagtgggagtccgactactacaacttctggaagaagctcccctgcgtcaagccccgcggcgtcgtcggcatcctcgacatctggggccagggcaccgtcgtcaccgtctcctcc

SEQ ID NO: 17164 - RNA, 432 nt, synthetic construct
  misc_feature 1..432: note = derived and/or modified sequence opt2 from anti-HIV_cap256-119-085772_VR-Chain
  source 1..432: mol_type = other RNA
gaggtccgcctcgtcgagtccggcggcggcctcatccagcccggcggctccctccgcctctcctgcgccgcctccggcctcaccgtctcctccaaccacatgtcctgggtccgccaggcccccggcaagggcctcgagtgggtcgccgtcatctcctacgacggctccaacaccttctacggcgactccgtcaagggccgcttcaccgtctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17165 - RNA, 432 nt, synthetic construct
  misc_feature 1..432: note = derived and/or modified sequence opt2 from anti-HIV_cap256-119-084603_VR-Chain
  source 1..432: mol_type = other RNA
caggtccagctcgtcgagtccggcggcggcgtcgtccagtccggccgctccctccgcctctcctgcgccgcctccggcttccccttctccgacttcgccatgcactgggtccgccaggcccccggcaagggcctcgagtgggtcgcctccatctccttcgtcggcatcaagacccactacgccaactccgtccgcggccgcttcaccatctcccgcgaccagtccaagaacaccctctacctccagatgaactccgtccgcgtcgaggacaccggccgctactactgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17166 - RNA, 432 nt, synthetic construct
  misc_feature 1..432: note = derived and/or modified sequence opt2 from anti-HIV_cap256-119-084276_VR-Chain
  source 1..432: mol_type = other RNA
caggtccagctcgtcgagtccggcggcggcgtcgtccagcccggccgctccctccgcctctcctgcgccgcctcccgcttcaccttctcctcctacgccatgcactgggtccgccaggcccccggcaagggcctcgagtgggtcgccgtcatctggtacgacggctccaacaagtactacgccgactccgtccgcggccgcttctccgtctccaccgacatctccaagaacaccctctacctccagatgaactccctccgccccgccgacaccgccctctacttctgcgcccgcgacctccgctactacgagtgcgaggagtgggcctccgactactacgacttcggcaaggagcagccctgcctcgacccccgcggcgtcgtcggcatcttcgacctctggggccagggcaccatggtcaccgtctcctcc

SEQ ID NO: 17167 - RNA, 432 nt, synthetic construct
  misc_feature 1..432: note = derived and/or modified sequence opt2 from anti-HIV_cap256-119-082288_VR-Chain
  source 1..432: mol_type = other RNA
caggtctacctcgtcgagtccggcggcggcgtcgtccagcccggccgctccctccgcctctcctccgccgcctcccacttctccctctcctcctacggcatgcactgggtccgccaggcccccggcaagggcctcgagtgggtcgccggcatctccttcgccggcaccaagacctactacggcgactccgtcaagggccgcttcaccgtctccaccgacatctccaagaacaccctctacctccaggtcaactccctccgccccgaggacaccgccatgtactactgcgcccgcgaccagcgctactacgagtgcgaggagtgggcctccgactactacgacttcggcaaggagcagccctgcctcgacccccgcggcgtcgtcggcatcttcgacatctggggccagggcaccatggtcaccgtctcctcc

SEQ ID NO: 17168 - RNA, 432 nt, synthetic construct
  misc_feature 1..432: note = derived and/or modified sequence opt2 from anti-HIV_cap256-119-080383_VR-Chain
  source 1..432: mol_type = other RNA
caggtccagctcgtcgagtccggcggcggcgtcgtccagcccggccgctccctccgcatctcctgcgccgcctcccagttcaccttctcccgctacggcatgcactgggtccgccaggcccccggcaagggcctcgagtgggtcgcctccatctcctacgacggcaccgacaagtaccacgcccgcctcgtctggggccgcttcaccatctcccgcgacaactccaagaacaccctctacctccagatgaactccctccgcgccgaggacaccgccctctactactgcgtccgcgacgagcgcgagtccgagtgcgagctctgggagtccgactactacgacttcggcaagaagctcccctgcgtcaagccccgcggcgtcaccggctccctcgacatgtggggccagggcacccaggtcaccgtctcctcc

SEQ ID NO: 17169 - RNA, 438 nt, synthetic construct
  misc_feature 1..438: note = derived and/or modified sequence opt2 from anti-HIV_cap256-119-079333_VR-Chain
  source 1..438: mol_type = other RNA
gaggtccagctcgtcgagtccggcggccgcctcgtccagcccggctcccccctccgcctctcctgcgccgcctcccagttcaacttcgcctcctacggcatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17170 - RNA, 441 nt, synthetic construct
  misc_feature 1..441: note = derived and/or modified sequence opt2 from anti-HIV_cap256-119-078618_VR-Chain
  source 1..441: mol_type = other RNA
cagatgcagctcgtcgagtccggcggcggcgtcgtccagcccggccgctccctcaccctctcctgcgccgcctcccagttcaacttcgcctcctacggcatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccaccctctacttctgcgtcaaggaccagcgcgaggacgagtgcgaggagtggtggtccgactactacgacttcggccgcgagctcccctgccgcaagtcccgcggcctcggcctcgccggcaacttctgcatctgcggcgccgacggcaccatggtcaccgtctcctcc

SEQ ID NO: 17171 - RNA, 432 nt, synthetic construct
  misc_feature 1..432: note = derived and/or modified sequence opt2 from anti-HIV_cap256-119-077466_VR-Chain
  source 1..432: mol_type = other RNA
caggtccagctcgtcgagtccggcggcggcgtcgtccagcccggctcccccctccgcatctcctgcgccgtctcccagttcaccttctcccgctacggcatgcactgggtccgccaggcccccggcaagggcctcgagtgggtcgcctccatctccttcgacggccgcgacaagtaccactcctccctcgtctggggccgcctcaccatctcccgcgacaactccaagtccaccctcttcctccagatgaactccctccgcgccgaggacaccgccctctactactgcgcccgcgacctccgcgagtccgagtgcgaggagtgggagtccgactactacgccttctaccgcaagctcccctgcgtcaagccccgcggcgtcgccggcaccctcgacatctggggccagggcaccatggtcaccgtctcctcc

SEQ ID NO: 17172 - RNA, 423 nt, synthetic construct
  misc_feature 1..423: note = derived and/or modified sequence opt2 from anti-HIV_cap256-119-076284_VR-Chain
  source 1..423: mol_type = other RNA
caggtccagctcgtcgagtccggcggcggcgtcgtccagcccggccgctccctccgcctctcctgcgccgcctccaacacctacgccatgcactgggtccgccaggcccccggcaagggcctcgagtggatggccctcatctcctacgagggctccgacaagtactacgtcgactccgtcaagggccgcttcaccatctcccgcgacaactccaagtccaccctctacctccagatgaactccctctccgccgaggacaccgccgtctacttctgcgccaaggacctcggcggcaacaaggacgacgagtggaccaccgactactactacgactggtccaaggcccgccccgtccaggacccccgcgtcgtcgccggcaccttcgacatctggggccagggcaccatggtcaccgtctcctcc

SEQ ID NO: 17173 - RNA, 432 nt, synthetic construct
  misc_feature 1..432: note = derived and/or modified sequence opt2 from anti-HIV_cap256-119-074680_VR-Chain
  source 1..432: mol_type = other RNA
gaggtccagctcgtcgagtccggcggcggcctcgtccagcccggccgctccctccgcctctcctgcgccggctccggcttcaccttcgtcgactacgccatgcactgggtccgccaggtccccggcaagggcctcgagtgggtcggctccatctcctacgacggctccgacaagtaccacaccaactccgtctggggccgcttcatcgtctcccgcgacaactccaagaacaccctctacctccagatgaactccctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17174 - RNA, 432 nt, synthetic construct
  misc_feature 1..432: note = derived and/or modified sequence opt2 from anti-HIV_cap256-119-074081_VR-Chain
  source 1..432: mol_type = other RNA
gaggtccagctcgtcgagtccggcggcggcctcgtccagcccggcggctccctccgcctctcctgcgtcgtctccggcgtcaccgtctcctccaactacatgtcctgggtccgccaggcccccggcaagggcctcgagtgggtcgcctccatctcctacgacggctccgacaagtaccacgccgaccgcgtctggggccgcttcaccatctcccgcgacaactccaagaacaccctctacctccagatgaactccctccgcgccgaggacaccgccctctactactgcgtccgcgacgcccgcgagtccgagtgcgagctctgggagtccgactactacaacttcggccgcaagctcccctgcgtcaagccccgcggcgtcgccggcaccctcgacatctggggccagggcaccatggtcaccgtctcctcc

SEQ ID NO: 17175 - RNA, 432 nt, synthetic construct
  misc_feature 1..432: note = derived and/or modified sequence opt2 from anti-HIV_cap256-119-071704_VR-Chain
  source 1..432: mol_type = other RNA
cagatgcagctcgtcgagtccggcggcggcgtcgtccagcccggcggctccctccgcctctcctgcgccgtctcccagttcaccttcacctcctacggcatgcactgggtccgccaggcccccggcaagggcctcgagtgggtcgccaccatctcctccgacggctccaagaagtaccacggcgactccgtctggggccgcctcaccatctcccgcgacaactccaagaacaccctcttcctccagatgaacaacctccgcgccgaggacaccgccctctacttctgcgtcaaggaccagcgcgaggacgagtgcgaggagtggtggtccgactactacgacttcggcaagaagctcccctgccgcaagtcccccggcctcgccggcatcttcgacgtctggggccacggcaccatggtcaccgtctccccc

SEQ ID NO: 17176 - RNA, 432 nt, synthetic construct
  misc_feature 1..432: note = derived and/or modified sequence opt2 from anti-HIV_cap256-119-071266_VR-Chain
  source 1..432: mol_type = other RNA
caggtccagctcgtcgagtccggcggcggcgtcgtccagcccggcgagtccctccgcctctcctgcgccgcctccggcttcaccttctcctccttcggcatgcactgggtccgccaggcccccggcaagggcctcgagtgggtcggctccatctcctacgacggctccgacaagtaccacaccaactccgtctggggccgcttcatcgtctcccgcgacaactccaagaacaccctctacctccagatgaactccctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17177 - RNA, 432 nt, synthetic construct
  misc_feature 1..432: note = derived and/or modified sequence opt2 from anti-HIV_cap256-119-069667_VR-Chain
  source 1..432: mol_type = other RNA
gaggtccagctcgtcgagtccggcggcggcctcgtccagcccggccgctccctccgcctctcctgcgccgcctccggcttctccttcaacacctacggcatgcactgggtccgccaggcccccggcaagggcctcgagtgggtcgccttcatccgctacgacggctccaacaagtactacgccgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17178 - RNA, 432 nt, synthetic construct
  misc_feature 1..432: note = derived and/or modified sequence opt2 from anti-HIV_cap256-119-069591_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccggcatctcctacgacggctccgacaagtaccacgccgacaaggtctggggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggcaagcgcctcccctgccgcaagtcccgcggcgtcgccggcgtcttcgacaagtggggccagggcaccatggtcaccgtctcctcc

SEQ ID NO: 17179 - RNA, 432 nt, synthetic construct
  misc_feature 1..432: note = derived and/or modified sequence opt2 from anti-HIV_cap256-119-068691_VR-Chain
  source 1..432: mol_type = other RNA
cagggccacctcgtcgcctccggcggcggcgtcgtcccccccggccgctccctcaccctctcctgcctcgcctcccagttcaccttctccggctacggcttccactgggtccgccaggcccccggcaagggcctcgagtgggtcgcctccatctccttcgccggcaccaagaagcactacggcaactccgtcaagggccgcttcaccatctcccgcgacaactccaagaacaccctctacctcgagatgaactccctccgccccgaggacaccgccctctactactgcgccaaggaccgccgcgagtacgagtgcgaggagtggacctccgactactacgacttcggccgcccccagccctgcatcgactcccgcggcgtcgtcggcatcctcgacatctggggccgcggcaccatggtcaccgtctcctcc

SEQ ID NO: 17180 - RNA, 432 nt, synthetic construct
  misc_feature 1..432: note = derived and/or modified sequence opt2 from anti-HIV_cap256-119-068488_VR-Chain
  source 1..432: mol_type = other RNA
cagatgcagctcgtcgagtccggcggcggcgtcgtccagcccggcatgtccctcaccctctcctgcgccgcctcccagttcaccttctccaactacggcatgcactgggtccgccaggcccccggcaagggcctcgagtgggtcgcctccatctccaacgacggctccaagaagtaccacggcgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17181 - RNA, 432 nt, synthetic construct
  misc_feature 1..432: note = derived and/or modified sequence opt2 from anti-HIV_cap256-119-067536_VR-Chain
  source 1..432: mol_type = other RNA
caggtccagctcgtcgagtccggcggcggcgtcgtccagcccggccgctccctccgcatctcctgcgcctcctcccagttcaccttctcccgctacggcatgcactgggtccgccaggcccccggcaagggcctcgagtgggtcgcctccatctcctacgacggccgcgactaccaccacgccggcgccgtctggggccgcttcatcatctcccgcgacaactccaagaactccctccacctccagatgaactccctccgccccgaggacaccgccctctacttctgcgcccgcgacctccgcgagtccgagtgcgaggagtgggagtccgactactacgccttctaccgcaagctcccctgcgtcaagccccgcggcgtcgccggcaccctcgacatctggggccagggcaccatggtcaccgtctcctcc

SEQ ID NO: 17182 - RNA, 432 nt, synthetic construct
  misc_feature 1..432: note = derived and/or modified sequence opt2 from anti-HIV_cap256-119-065852_VR-Chain
  source 1..432: mol_type = other RNA
caggtccacctcgtcgagtccggcggcggcgccgtcccctccggccgctccctccgcctctcctgcgtcgcctccggcttcaccttcggcgtctacgacatccactgggtccgccaggcccccggcaagggcctcgagtgggtcgcctccatctcctacgacggccgcgacaagtaccactcctccctcgtctggggccgcctcaccatctcccgcgacaactccaagtccaccctcttcctccagatgaactccctccgcgccgaggacaccgccctctactactgcgcccgcgacctccgcgagtccgagtgcgaggagtggcagtccgactactacgccttctacaagaagctcccctgcgtcaagccccgcggcgtcgccggcaccctcgacatctggggccagggcaccatggtcaccgtctcctcc

SEQ ID NO: 17183 - RNA, 432 nt, synthetic construct
  misc_feature 1..432: note = derived and/or modified sequence opt2 from anti-HIV_cap256-119-065457_VR-Chain
  source 1..432: mol_type = other RNA
ctcggccgcctcgtcgcctccggcggcggcgtcgtcccccccggccgctccccccgcctctcctgcgtcgcctcccagttcaccttctccggctgcggcctccactgggtccgccaggcccccggcaagggcctcgagtgggtcgccgccatctccttcgacggcaccgacaagtaccactccgacgacgtctggggccgcttcaccatctcccgcgacaactccaagaacaccctctacctccagatgaactccctccgccccgaggacaccgccctctactactgcgccaaggacctccaggaggacgagtgcgaggagtggtggtccgactactacgacttcggcaagcagctcccctgccgcaagtcccgcggcgtcgccggcatcttcgacgactggggccagggcaccatggtcaccgtctcctcc

SEQ ID NO: 17184 - RNA, 432 nt, synthetic construct
  misc_feature 1..432: note = derived and/or modified sequence opt2 from anti-HIV_cap256-119-064501_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccggcatctcctacgacggccgcgacaagtaccacgcccactccgtctggggccgcctctccatctcccgcgacaactccaagaacaccctctacctccagatgaactccctccgcaccgaggacaccgccctctaccactgcgtccgcgacctccgcgagtccgagtgcgagctctgggagtccgactactacgacttcggcaagaagctcccctgcgtcaagccccgcggcgtcgccggcaccttcgacctctggggccagggcaccatggtcaccgtctcctcc

SEQ ID NO: 17185 - RNA, 432 nt, synthetic construct
  misc_feature 1..432: note = derived and/or modified sequence opt2 from anti-HIV_cap256-119-063568_VR-Chain
  source 1..432: mol_type = other RNA
caggtccagcccgtcgagtccggcggcggcgtcgtctggcccggccgctccctccgcctctcctgcaccacctccggcttcaccttctccaactacgccatccactgggtccgccaggcccccggcaagggcctccagtgggtcgccgtcatctcctacgacggctccaacaagttctacgccgactccgtcaagggccgcttcaccatctcccgcgacaactccaagaacaccctctacctccagatgaactccctccgccccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17186 - RNA, 435 nt, synthetic construct
  misc_feature 1..435: note = derived and/or modified sequence opt2 from anti-HIV_cap256-119-063103_VR-Chain
  source 1..435: mol_type = other RNA
caggtccagctcgtcgagtccggcggcggcctcgtccagcccggcaagtccctccgcctctcctgcgccgcctccggcttcaccttctccacctacggcatgcactgggtccgccaggcccccggcaagggcctcgagtgggtcgccctcatctcctacgacggctcctacacctactacgccgactccgtcaagggccgcttcaccatctcccgcgacaactccaagtccaccctcgacctccagctcaacaccctccgccccgaggacaccgccctctactactgcgcccgcgacctccgcgagatggagtgcgaggagtggaagctctacaactactacgacttccgcacccgcggcccctgcgtcgacccccgcggcgtcgtcggctccttcgacgtctggggccagggcaccgtcgtcaccgtctcctcc

SEQ ID NO: 17187 - RNA, 432 nt, synthetic construct
  misc_feature 1..432: note = derived and/or modified sequence opt2 from anti-HIV_cap256-119-061027_VR-Chain
  source 1..432: mol_type = other RNA
caggtccagctcgtcgagtccggcggcggcgtcgtccagcccggccgctccctccgcctctcctgctccgcctccggcttcaccctctcctcctacggcatccactgggtccgccaggcccccggcaagggcctcgagtgggtcgccgtcatgtccaacgacggctccaaccagttctacggcgactccgtcaagggccgcttcaccatctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17188 - RNA, 432 nt, synthetic construct
  misc_feature 1..432: note = derived and/or modified sequence opt2 from anti-HIV_cap256-119-058232_VR-Chain
  source 1..432: mol_type = other RNA
caggtccagctcgtcgagtccggcggcggcgtcgtccagcccggcaagtccctccgcctctcctgcaaggcctcccagttcaccttcaaccgctacggcatgcactgggtccgccaggcccccggcaagggcctcgagtgggtcgccgccatctccttcgacggcaccgacaagtaccacgccgacaaggtctggggccgcttcaccatctcccgcgacgactccaagtccaccctctacctccagatgaactccctccgcgccgaggacaccgccctctactactgcgccaaggacctccgcgaggacgagtgcgaggagtggtggtccgactactacgacttcggcaagcagctcccctgccgcaagtcccgcggcgtcgccggcatcttcgacggctggggccagggcaccatggtcaccgtctcctcc

SEQ ID NO: 17189 - RNA, 432 nt, synthetic construct
  misc_feature 1..432: note = derived and/or modified sequence opt2 from anti-HIV_cap256-119-057341_VR-Chain
  source 1..432: mol_type = other RNA
caggtccagctcgtcgagtccggcggcggcgtcgtccagcccggccgctccctccgcctctcctgcgccgcctcccacttctccctctcctcctacggcatgcactgggtccgccaggcccccggcaagggcctcgagtgggtcgccggcgagtccttcgccgccaccaacaagtactacgccgactccgtcaagggccgcttcatcgtctcccgcgacatctccaagaacaccctctacctcgaggtcaactccctccgcgccgaggacaccgccctctactactgcgcccgcgaccagcgctactacgagtgcgaggagtgggcctccgactactacgacttcggccgcgagcagccctgccaggacccccgcggcgtcgccggcatcttcgacatctggggccagggcaccatggtcaccgtctcctcc

SEQ ID NO: 17190 - RNA, 438 nt, synthetic construct
  misc_feature 1..438: note = derived and/or modified sequence opt2 from anti-HIV_cap256-119-056895_VR-Chain
  source 1..438: mol_type = other RNA
cagatgcagctcgtcgagtccggcggcggcgtcgtccagcccggccgctccctccgcctctcctgcgccgcctcccagttcaccttcggctcctacggcatgcactgggtccgccagatccccggcaagggcctcgagtgggtcgccaccatctcctacgacggcaccaagaagtaccacgccgactccgtctgggaccgcttcatcatctcccgcgacaactccaagaacaccctcttcctccagatgaactccctccgccccgaggacaccgccctctacttctgcgtcaaggaccagcgccaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17191 - RNA, 432 nt, synthetic construct
  misc_feature 1..432: note = derived and/or modified sequence opt2 from anti-HIV_cap256-119-056402_VR-Chain
  source 1..432: mol_type = other RNA
caggtcaagctcgtcgagtccggcggcggcgtcgtccagcccggcaagtccctccgcctctcctgcaccgcctcccagttcaccttctccaacttcggcatgcactgggtccgccaggcccccggcaagggcctcgagtgggtcgcctccatctccttcgtcggcatcaagaagcactacgccaactccgtccgcggccgcttcaccatctcccgcgaccagtccaagaacaccctctacctccagatgaactccgtccgcgtcgaggacaccgcccgctacttctgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17192 - RNA, 432 nt, synthetic construct
  misc_feature 1..432: note = derived and/or modified sequence opt2 from anti-HIV_cap256-119-056034_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgccatctccttcgccggcaccaagacccactacgccgactccgtcaagggccgcttcaccatctcccgcgacaactccaagaacgccctctacctccagatgaacaacctccgcgccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17193 - RNA, 432 nt, synthetic construct
  misc_feature 1..432: note = derived and/or modified sequence opt2 from anti-HIV_cap256-119-055042_VR-Chain
  source 1..432: mol_type = other RNA
caggtccagctcgtcgagtccggcggcggcgtcgcccagcccggccgctccctccgcctctcctgcgccgcctccggcttcaccttccgctcctacggcatgcactgggtccgccaggcccccggcaagggcctcgagtgggtcgccgtcatctccctcgacggctccaacaagtactacgccgactccgtcaagggccgcttctccatctcccgcgacaactccaagaacaccctctacctccagatgaactccctccgccccgaggacaccgccgtctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17194 - RNA, 438 nt, synthetic construct
  misc_feature 1..438: note = derived and/or modified sequence opt2 from anti-HIV_cap256-119-054776_VR-Chain
  source 1..438: mol_type = other RNA
caggtccagctcatggagtccggcggcggcgtcgtccagcccggccgctccctccgcctctcctgcaccgcctccggcttcaccttctcctcctactccatgcactgggtccgccaggcccccggcaagggcctcgagtgggtcgccatcatctcctacgacgagtccaacaagtactacgccgactccgtccagggccgcttcaccatctcccgcgacaactccaagaacaccctcttcctccagatgtcctccctccgcgccgaggacaccgccctctacttctgcgtccgcgaccaccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17195 - RNA, 432 nt, synthetic construct
  misc_feature 1..432: note = derived and/or modified sequence opt2 from anti-HIV_cap256-119-054539_VR-Chain
  source 1..432: mol_type = other RNA
cagatgcagctcgtcgagtccggcggcggcgtcgtccagcccggcggctccctccgcctctcctgcgccgcctcccagttcaccttcggctcctacgccatgcactgggtccgccagccccccggcgagcgccccgagtgggtcgccaccatctccttcgacggcaccaagaagtaccacgccgactccgtctggggccgcttcaccatctcccgcgacaactccaagaacaccctcttcctccagatgaactccctccgccccgaggacaccgccctctacttctgcgtcaaggaccagcgcgaggacgcctgcgaggagtggtggtccgactactacgacttcggcaagaactgcctcgccgagtcccccggcgcctggctcgagttcttctacgtctggggccacggcaccatggtcaccgtctcctcc

SEQ ID NO: 17196 - RNA, 432 nt, synthetic construct
  misc_feature 1..432: note = derived and/or modified sequence opt2 from anti-HIV_cap256-119-054112_VR-Chain
  source 1..432: mol_type = other RNA
caggtccagctcgtcgagtccggcggcggcgtcgtccaggccggccgctccctccgcctctcctgcgccgcctccggcttcaccttctccacctacgccatgcactgggtccgccaggcccccggcaagggcctcgagtgggtcgccgtcatctcctacgacggctccaacaagtactacgccgactccgtccgcggccgcttcaccatctcccgcgacaactccaagaacaccctctacctccagatgaactccctccgcgccgaggacaccgccctctactactgcgccaaggacatgcgcgagtacgagtgcgaggagtggacctccgactactacgacttcggccgcccccagccctgcatcgactcccgcggcgtcgtcggcaccttccacgtctggggccagggcaccatggtcaccgtctcctcc

SEQ ID NO: 17197 - RNA, 432 nt, synthetic construct
  misc_feature 1..432: note = derived and/or modified sequence opt2 from anti-HIV_cap256-119-053339_VR-Chain
  source 1..432: mol_type = other RNA
caggtccacctcgtcgagtccggcggcggcgtcgtccagcccggccgctccctccgcctctcctgcgccgcctcccacttctccctctcctcctacggcatgcactgggtccgccaggcccccggcaagggcctcgagtgggtcaccggcatctccttcgccggcaccaagacctactacggcgactccgtccgcggccgcttcaccgtctcccgcgacatctccaagaacaccctcctcctccagatgaactccctccgccccgacgacaccgccatctactactgcgcccgcgaccagcgctactacgagtgcgaggagtgggcctccgactactacgacttcggcaaggagcagccctgcctcgacccccgcggcgtcgtcggcatcttcgacctctggggccagggcaccatggtcaccgtctcctcc

SEQ ID NO: 17198 - RNA, 432 nt, synthetic construct
  misc_feature 1..432: note = derived and/or modified sequence opt2 from anti-HIV_cap256-119-052404_VR-Chain
  source 1..432: mol_type = other RNA
cagatgcagctcgtcgagtccggcggcggcgtcgtccagcccggccgctccctcaccctctcctgcatcgcctcccagttcaacttcgcctcctacggcatgcactgggtccgccaggcccccggcaagggcctcgagtgggtcgcctccatctcccacgacggcaccaagaagtaccacgccgagtccgtctggggccgcttcaccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggcaagcagctcccctgccgcaagtcccgcggcgtcgccggcgtcttcgacaactggggccagggcaccatggtcaccgtctcctcc

SEQ ID NO: 17199 - RNA, 432 nt, synthetic construct
  misc_feature 1..432: note = derived and/or modified sequence opt2 from anti-HIV_cap256-119-051123_VR-Chain
  source 1..432: mol_type = other RNA
caggtccagctcgtcgagtccggcggcggcgtcgtccagcccggcggctccctccgcctctcctgcgtcggctcccagttcatcctctaccgctacggcatgcactgggtccgccaggcccccggcaagggcctcgagtgggtcgccgccgtctccttcgacggcaccgacaagtaccacgccgacgacgtctggggccgcttcaccatctcccgcgacaactccaagaacatcctctacctccagatgaactccctccgcgccgaggacaccgccctctactactgcgccaaggacctccgcgaggacgagtgcgaggagtggtggtccgactactacgacctcggcaagcagctcccctgccgcaagtcccgcggcgtcgccggcgtcttcgacaagtggggcctcggcaccatggtcaccgtctcctcc

SEQ ID NO: 17200 - RNA, 438 nt, synthetic construct
  misc_feature 1..438: note = derived and/or modified sequence opt2 from anti-HIV_cap256-119-051077_VR-Chain
  source 1..438: mol_type = other RNA
gaggtccagctcgtcgagtccggcggcggcgtcgtccagtccggccgctccctccgcctctcctgcgccgcctcccacttcaccttctcccgctacggcatgcactgggtccgccaggcccccggcaagggcctcgagtgggtcgcctccatctcctacgacggccgcgacttctaccacgcccgctccgtctggggccgcttcaccatctcccgcgacaactccaagaacaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17201 - RNA, 432 nt, synthetic construct
  misc_feature 1..432: note = derived and/or modified sequence opt2 from anti-HIV_cap256-119-050442_VR-Chain
  source 1..432: mol_type = other RNA
caggcccagatggtcgagtccggcggcggcgtcgtccagcccggccgctccctccgcctctcctgcgccgcctccggcttctccttctcctacttcgccatgcactgggtccgccaggcccccggcaagggcctcgagtgggtcgccggcatctccttcgccgccaccaagacctactacggcggctccgtcaagggccgcttcaccgtctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17202 - RNA, 432 nt, synthetic construct
  misc_feature 1..432: note = derived and/or modified sequence opt2 from anti-HIV_cap256-119-049433_VR-Chain
  source 1..432: mol_type = other RNA
caggtccagctcgtcgagtccggcggcggcgtcgtccagcccggccgctccctccgcgtctcctgccgcgcctccggcttcgccttctcctcctacgccatgcactgggtccgccaggcccccgtcaagggcctcgagtgggtcgccctcacctcctccgacggcgccgacaagtaccacgccgacgacgtctggggccgcttcaccatctcccgcgacaactccaagaacaccctctacctccagatgaactccctccgccccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17203 - RNA, 432 nt, synthetic construct
  misc_feature 1..432: note = derived and/or modified sequence opt2 from anti-HIV_cap256-119-047532_VR-Chain
  source 1..432: mol_type = other RNA
ctcggccgcctcgtcgcctccggcggcggcgtcgtcccccccggccgctccctcaccctctcctgcgtcgcctcccagttcaccttctccggctgcggcctccactgggtccgccaggcccccggcaagggcctcgagtgggtcgcctccatctccttcgccggcaccaagaagcactacaccaactccgtccgcggccgcttcaccatctcccgcgacaactccaagaacaccgtctacctccagatgaactccctccgcgccgaggacaccgccctctactactgcgccaaggacatgggcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17204 - RNA, 432 nt, synthetic construct
  misc_feature 1..432: note = derived and/or modified sequence opt2 from anti-HIV_cap256-119-047489_VR-Chain
  source 1..432: mol_type = other RNA
caggtccacctcgtcgagtccggcggcggcgtcgtccagcccggcaagtccctccgcctctcctgcgccgcctcccagttcaccttcaaccgcttcggcatgcactgggtccgccaggcccccggcaagggcctcgagtgggtcgccggcatctcctacgacggctccgacaagtaccacgccgacaaggtctggggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggcaagcgcctcccctgccgcaagtcccgcggcgtcgccggcgtcttcgacaagtggggccagggcaccatggtcaccgtctcctcc

SEQ ID NO: 17205 - RNA, 438 nt, synthetic construct
  misc_feature 1..438: note = derived and/or modified sequence opt2 from anti-HIV_cap256-119-046020_VR-Chain
  source 1..438: mol_type = other RNA
gaggtccagctcctccagtccggcggcggcctcgtccagcccggcggctccctccgcctctcctgcgccgcctccggcttctccttctcctcctacgccatgtcctggatccgccaggcccccggcaagggcctcgagtgggtcgcctccatctcccacgacggcaccaagaagtaccacgccgagtccgtctggggccgcttcaccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17206 - RNA, 432 nt, synthetic construct
  misc_feature 1..432: note = derived and/or modified sequence opt2 from anti-HIV_cap256-119-044746_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccgtctacctcgagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17207 - RNA, 432 nt, synthetic construct
  misc_feature 1..432: note = derived and/or modified sequence opt2 from anti-HIV_cap256-119-044740_VR-Chain
  source 1..432: mol_type = other RNA
cagatgcacctcgtcgagtccggcggcggcgtcgtccagcccggcatgtccctccgcctctcctgcgccgcctcccagttcaacttcggctccttcggcatgcactgggtccgccaggcccccggcaagggcctcgagtgggtcgccaccatctcctacgacggcaccaagaagtaccactccgactccgtctggggccgcctctccatctcccgcgacaactccaagaacaccctcttcctccagatgaactccctccgcaccgaggacaccgccctctacttctgcgtccgcgaccagcgcgaggacgactgcgaggagtggtggtccgactactacgacttcggcaagaagctcccctgccgcaagtcccgcggcctcgccggcatcttcgacatctggggccacggcaccatggtcaccgtctcctcc

SEQ ID NO: 17208 - RNA, 432 nt, synthetic construct
  misc_feature 1..432: note = derived and/or modified sequence opt2 from anti-HIV_cap256-119-043790_VR-Chain
  source 1..432: mol_type = other RNA
ctcctccagctcgtcgagtccggcggcggcgtcgtccagcccggcaactccctccgcctctcctgcgccgccgccggcttcaccttctccgactactccctccactgggtccgccaggcccccggcaagggcctcgagtgggtcgccatgatctccgacgacggcaacctcgacttctacgccgcctccgtcaagggccgcttcaccatctcccgcgacaactccatcaacaccgtctacctccagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17209 - RNA, 432 nt, synthetic construct
  misc_feature 1..432: note = derived and/or modified sequence opt2 from anti-HIV_cap256-119-042880_VR-Chain
  source 1..432: mol_type = other RNA
gaggtccgcctcgtcgagtccggcggcggcctcgtccagcccggcggctccctccgcctctcctgcgccgcctccggcttcaccctctccgactactacatgtcctggatccgccaggcccccggcaagggcctcgagtgggtcgccgccatctccttcgccggcaccaagaagcactacggcaactccgtcaagggccgcttcaccatctcccgcgacaactccaagaacaccctctacctcgagatgaactccctccgcgtcgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17210 - RNA, 432 nt, synthetic construct
  misc_feature 1..432: note = derived and/or modified sequence opt2 from anti-HIV_cap256-119-042606_VR-Chain
  source 1..432: mol_type = other RNA
cagatgcagctcgtcgagtccggcggcggcgtcgtccagcccggccgctccctccgcctctcctgcgccgcctcccagttcaccttcggctcctacggcatgcactgggtccgccagatccccggcaagggcctcgagtgggtcaccggcatctccttcgccgccaccaagacctactacggcgactccgtccgcggccgcttcaccgtctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcatcctcgacctctggggccagggcaccatggtcaccgtctcctcc

SEQ ID NO: 17211 - RNA, 432 nt, synthetic construct
  misc_feature 1..432: note = derived and/or modified sequence opt2 from anti-HIV_cap256-119-042444_VR-Chain
  source 1..432: mol_type = other RNA
caggtccagctcgtcgagtccggcggcgacgtcgtccaccccggcggctccctccgcctctcctgcgccgcctccggcttcaccttctcctcctacggcatccactgggtccgccaggcccccggcaagggcctcgagtgggtcgccgccatctcctacgacggctccgacaagtaccacaccaactccgtctggggccgcttcaccgtctcccgcgacaactccaagaacaccgtctacctccagatgaactccctccgcgccgaggacaccgccctctacttctgcgtccgcgaccgccgcgagtccgagtgcgagctctgggagtccgactactacgacttcggcaagcgcctcccctgcgtcaagccccgcggcgtcgccggcgtcttcgacatctggggccagggcaccatggtcaccgtctcctcc

SEQ ID NO: 17212 - RNA, 432 nt, synthetic construct
  misc_feature 1..432: note = derived and/or modified sequence opt2 from anti-HIV_cap256-119-040328_VR-Chain
  source 1..432: mol_type = other RNA
caggtccagctcgtcgagtccggcggcggcgtcgtccagcccggcggctccctccgcctctcctgcgccgcctccggcttcaccttctcctcctactccatgaactgggtccgccaggcccccggcaagggcctcgagtgggtcgcctccatctccttcgccggcaccaagcagcactacggcaactccgtcaagggccgcttcaccatctcccgcgacaactccaagaacaccgtctacctccagatgaactccctccgcctcgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17213 - RNA, 432 nt, synthetic construct
  misc_feature 1..432: note = derived and/or modified sequence opt2 from anti-HIV_cap256-119-040164_VR-Chain
  source 1..432: mol_type = other RNA
cagatgcacctcgtcgagtccggcggcggcgtcgtccagcccggcatgtccctccgcctctcctgcgccgcctcccagttcaacttcggctccttcggcatgcactgggtccgccaggcccccggcaagggcctcgagtgggtcgccaccatctcctacgacggcaccaagaagtaccactccgactccgtctggggccgcttctccatctcccgcgacaactccaagaacaccctctacctccagatgaactccctccgcaccgaggacaccgccctctacttctgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17214 - RNA, 432 nt, synthetic construct
  misc_feature 1..432: note = derived and/or modified sequence opt2 from anti-HIV_cap256-119-039130_VR-Chain
  source 1..432: mol_type = other RNA
gaggagcagctcgtcgagtccggcggcggcctcgtccagcccggccgctccctccgcctctcctgcaccggctccggcttccgcttcggcgactacgccatgaactgggtccgccaggcccccggcaagggcctcgagtgggtcaccttcatctcctacgacggctccaacaagcactacgccgactccgtcaagggccgcttcaccgtctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17215 - RNA, 432 nt, synthetic construct
  misc_feature 1..432: note = derived and/or modified sequence opt2 from anti-HIV_cap256-119-038138_VR-Chain
  source 1..432: mol_type = other RNA
caggtccagctcgtcgagtccggcggcggcgtcgtccagaccggccgctccctccgcctctcctgcaccggctcccagttcaccttcggccgctacggcatgtactgggtccgccaggcccccggcaagggcctcgagtgggtcgcctccatctcctacgacggccgcgacttctaccacgcccgctccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17216 - RNA, 432 nt, synthetic construct
  misc_feature 1..432: note = derived and/or modified sequence opt2 from anti-HIV_cap256-119-037868_VR-Chain
  source 1..432: mol_type = other RNA
caggtccagctcgtcgagtccggcggcggcgtcgtccagcccggccgctccctccgcctctcctgcgccgcctcccagttcaccttctccaagtacggcatgcactgggtccgccaggcccccggcaagggcctccagtgggtcgccggcatctcctacgacggctccgacaagtaccacgcccacttcgtctggggccgcttctccatctcccgcgacaactccaagaacgccctctacctccagatgaactccctccgcaccgaggacaccgccctctacttctgcgtccgcgacctccgcgagtccgagtgcgaggagtggaagtccgactactacgacttcggccgcaagggcccctgcctcaagccccgcggcgtcgccggctccttcgacatctggggccagggcaccgtcgtcaccgtctcctcc

SEQ ID NO: 17217 - RNA, 432 nt, synthetic construct
  misc_feature 1..432: note = derived and/or modified sequence opt2 from anti-HIV_cap256-119-037102_VR-Chain
  source 1..432: mol_type = other RNA
caggtcaagctcgtcgagtccggcggcggcgtcgtccagcccggcaagtccctccgcctctcctgcaccgcctcccagttcaccttctccaacttcggcatgcactgggtccgccaggcccccggcaagggcctcgagtgggtcgcctccatctccttcgtcggcatcaagaagcactacgccaacttcgtccgcggccgcttcaccatctcccgcgaccagtccaagaacaccctctacctccagatgaactccgtccgcgtcgaggacaccgcccgctactactgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17218 - RNA, 438 nt, synthetic construct
  misc_feature 1..438: note = derived and/or modified sequence opt2 from anti-HIV_cap256-119-036683_VR-Chain
  source 1..438: mol_type = other RNA
ggcgtccagctcgtcgagtccggcggcgccgtcgtccgccccggcggctccctcaccctctcctgcgccgcctcccagttcatcctctcctcctacggcatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17219 - RNA, 432 nt, synthetic construct
  misc_feature 1..432: note = derived and/or modified sequence opt2 from anti-HIV_cap256-119-036495_VR-Chain
  source 1..432: mol_type = other RNA
caggtccagctcgtcgagtccggcggcggcgtcgtccagcccggccgctccctccgcctctcctgcgccgcctccggcttctccttctcctcctacggcatgcactgggtccgccaggcccccggcaagggcctcgagtgggtcgcctccatctccttcgtcggcatcaagacccactacgccaactccgtccgcggccgcttcaccatctcccgcgaccagtccaagaacaccctctacctccagatgaactccgtccgcatcgaggacaccgcccgctacttctgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17220 - RNA, 438 nt, synthetic construct
  misc_feature 1..438: note = derived and/or modified sequence opt2 from anti-HIV_cap256-119-035375_VR-Chain
  source 1..438: mol_type = other RNA
gaggtccagctcgtcgagtccggcggcggcctcgtccagcccggccgctccctccgcctctcctgcgccgcctccggcttcaccctcgaggactacggcatgcactgggtccgccaggcccccggcaagggcctcgagtgggtcgcctccatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17221 - RNA, 438 nt, synthetic construct
  misc_feature 1..438: note = derived and/or modified sequence opt2 from anti-HIV_cap256-119-035165_VR-Chain
  source 1..438: mol_type = other RNA
caggtccacctcgtcgagtccggcggcggcgtcggccagcccgcccgctccctccgcctctcctgcgccgcctccggcttcatcctctcctcctacggcctccactgggtccgccaggcccccggcaagggcctcgagtgggtcgccctcatctcctacgacggcaacaacgagtactacgccgagtccgtctggggccgcttcaccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17222 - RNA, 432 nt, synthetic construct
  misc_feature 1..432: note = derived and/or modified sequence opt2 from anti-HIV_cap256-119-035109_VR-Chain
  source 1..432: mol_type = other RNA
caggtccagctcgtcgagtccggcggcggcgtcgtccagcccggccgctccctccgcctctcctgcgccaccgccggcttcaccttctcctcctacgccatgcactgggtccgccaggcccccggcaagggcctcgagtgggtcgcctccatctcctacgacggctccgacaagtaccacgccgacctcgtctggggccgcttcaccatctcccgcgacaactccaagaacaccctctacctccagatgaactccctccgcgccgaggacaccgccctctactactgcgtccgcgacgcccgcgagtccgagtgcgagctctgggagtccgactactacaacttcggccgcaagctcccctgcgtcaagccccgcggcgtcgccggcaccctcgacatctggggccagggcaccatggtcaccgtctcctcc

SEQ ID NO: 17223 - RNA, 339 nt, synthetic construct
  misc_feature 1..339: note = derived and/or modified sequence opt2 from anti-HIV_cap256-119-033789_VR-Chain
  source 1..339: mol_type = other RNA
caggtctacctcgtcgagtccggcggcggcgtcgtccagcccggccgctccctccgcctctcctgcgccgcctcccacttctccctctcctcctacggcatgcactgggtccgccaggcccccgacatctccaagaacaccctctacctccaggtcaactccctccgccccgaggacaccgccatgtactactgcgcccgcgaccagcgctactacgagtgcgaggagtgggcctccgactactacgacttcggcaaggagcagccctgcctcgacccccgcggcgtcgtcggcatcttcgacatctggggccagggcaccatggtcaccgtctcctcc

SEQ ID NO: 17224 - RNA, 432 nt, synthetic construct
  misc_feature 1..432: note = derived and/or modified sequence opt2 from anti-HIV_cap256-119-033641_VR-Chain
  source 1..432: mol_type = other RNA
caggtccagctcgtcgagtccggcggcggcgtcgtccagaccggccgctccctccgcctctcctgcaccggctcccagttcaccttcggccgctacggcatgtactgggtccgccaggcccccggcaagggcctcgagtgggtcgccgccatctcctacgacggctccgacaagtaccacaccaactccgtctggggccgcttcaccgtctcccgcgacaactccaagaacaccgtctacctccagatgaactccctccgcgccgaggacaccgccctctacttctgcgtccgcgaccgccgcgagtccgagtgcgagctctgggagtccgactactacgacttcggcaagcgcctcccctgcgtcaagccccgcggcgtcgccggcgtcttcgacatctggggccagggcaccatggtcaccgtctcctcc

SEQ ID NO: 17225 - RNA, 432 nt, synthetic construct
  misc_feature 1..432: note = derived and/or modified sequence opt2 from anti-HIV_cap256-119-032113_VR-Chain
  source 1..432: mol_type = other RNA
caggtccagctcgtcgagtccggcggcggcgtcgtccagcccggccgccccctccgcctctcctgcgtcggctccggcttctccttcatcacctccgccatgcactgggtccgccaggcccccgacaagggcctcgagtgggtcgccatcatctccgacggcggcaacaaccgccactacgccgactccgtcaagggccgcttcaccatctcccgcgacaactccaagaacaccgtcttcctcgaggtcaacaacctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17226 - RNA, 432 nt, synthetic construct
  misc_feature 1..432: note = derived and/or modified sequence opt2 from anti-HIV_cap256-119-031739_VR-Chain
  source 1..432: mol_type = other RNA
caggtccagctcgtcgagtccggcggcggcgtcgtccagcccggccgctccctccgcatctcctgcgccgcctcccagttcaccttcaaccgctacggcatgcactgggtccgccaggcccccggcaagggcctcgagtgggtcgcctccatctcctacgacggctccgacaagtaccacgccggcctcgtctggggccgcttcatcatctcccgcgacaactccaagaacaccctctacctccagatgaactccctccgcgccgaggacaccgccctctactactgcgtccgcgacgagcgcgagtccgagtgcgagctctgggagtccgactactacgacttcggcaagaagctcccctgcgtcaagccccgcggcgtcgccggcaccctcgacatctggggccagggcacccgcgtcaccgtctcctcc

SEQ ID NO: 17227 - RNA, 432 nt, synthetic construct
  misc_feature 1..432: note = derived and/or modified sequence opt2 from anti-HIV_cap256-119-030932_VR-Chain
  source 1..432: mol_type = other RNA
gaggtccagctcctcgagtccggcggcggcgtcgtccagcccggccgctccctccgcctctcctgcgccgcctccggcttcgccttctcccactacggcatcttctgggtccgccaggcccccggcaagggcctcgagtgggtcaccgtcatctccggcgacggctccacccagtggtacgccgactccgtccagggccgcttcaccatctcccgcgactcctccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17228 - RNA, 438 nt, synthetic construct
  misc_feature 1..438: note = derived and/or modified sequence opt2 from anti-HIV_cap256-119-030740_VR-Chain
  source 1..438: mol_type = other RNA
caggtccagctcgtcgagttcggcggcggcgtcgtccagaccggccgctccctccgcctctcctgcgccgcctccggcttcaccttctccgactacggcatgcactgggtccgccaggcccccggcaagggcctcgagtgggtcgcctccatctccaacgacggctccaagaagtaccacggcgactccgtctgggcccgcttcatcatctcccgcgacaactccaagaacaccctcttcctccagatgtcctccctccgcgccgaggacaccgccctctacttctgcgtccgcgaccaccgcgaggacgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17229 - RNA, 438 nt, synthetic construct
  misc_feature 1..438: note = derived and/or modified sequence opt2 from anti-HIV_cap256-119-030197_VR-Chain
  source 1..438: mol_type = other RNA
caggtccacctcgtcgagtccggcggcggcgtcgtccagcccggcaagtccctccgcctctcctgcgccgcctcccagttcaccttctgccgctacggcatgcactgggtccgccaggcccccggcaagggcctcgagtgggtcgcctccatctccaacgacggcaccgacaagtaccacgccgacaacgtctggggccgcttcaccatctcccgcgacaactccaagaacaccctctacctcgagatgaactccctccgcggcgaggacaccgccctctactactgcgccaaggacatgcgcgaggacgagtgcgaggagtggtggtccgactactacgacttcggcaaggagctcccctgccgcaagtggaagacccgcggcgtcgccggcatcctcgacaactggggccagggcaccatggtcaccgtctcctcc

SEQ ID NO: 17230 - RNA, 438 nt, synthetic construct
  misc_feature 1..438: note = derived and/or modified sequence opt2 from anti-HIV_cap256-119-027047_VR-Chain
  source 1..438: mol_type = other RNA
cagatgcagctcgtcgagtccggcggcggcgtcgtccagcccggccgctccctcaccctctcctgcgccgcctcccagttcaccttccgcaactacggcatgcactgggtccgccaggcccccggcaagggcctcgagtgggtcgcctccatctccaaggacggcaccaagaagtaccacggcgactccgtctggggccgcttcatcatctcccgcgacaactccaagaacaccctcttcctccagatgtcctccctccgcgccgaggacaccgccctctacttctgcgtccgcgaccagcgcgaggccgagtgcgaggagtggtggtccgactactacgacttcggccgcgagctcccctgccgcaagttccgcggcctcggcctcgccggcatcttcgacatctggggccacggcaccatggtcaccgtctcctcc

SEQ ID NO: 17231 - RNA, 432 nt, synthetic construct
  misc_feature 1..432: note = derived and/or modified sequence opt2 from anti-HIV_cap256-119-026950_VR-Chain
  source 1..432: mol_type = other RNA
caggtccagctcgtcgagtccggcggcggcgtcgtccagcccggcaagtccctccgcatctcctgcgccgcctcccgcttcaccttcggccgcttcggcatgcactgggtccgccaggcccccggcaagggcctcgagtgggtcgcctccatctcctacgacggctccgacaagtaccacgccggcctcgtctggggccgcttcatcatctcccgcgacaactccaagaacaccctctacctccagatgaactccctccgcgccgaggacaccgccctctactactgcgtccgcgacgagcgcgagtccgagtgcgagctctgggagtccgactactacaacttcggcaagaactacccctgcgtcaagccccgcggcgtcgccggcaccctcgacatctggggccagggcaccaccgtcatcgtctcctcc

SEQ ID NO: 17232 - RNA, 438 nt, synthetic construct
  misc_feature 1..438: note = derived and/or modified sequence opt2 from anti-HIV_cap256-119-026279_VR-Chain
  source 1..438: mol_type = other RNA
cagatgcagctcgtcgagtccggcggcggcgtcgtccagcccggcacctccctcaccctctcctgcgccgcctcccagttctccttcacctcctacggcatgcactgggtccgccaggcccccggcaagggcctcgagtgggtcgcctccatctccaacgacggcaccaagaagtaccacgccgagtccgtctggggccgcttcaccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatctggggccacggcaccgtcgtcatcgtctcctcc

SEQ ID NO: 17233 - RNA, 432 nt, synthetic construct
  misc_feature 1..432: note = derived and/or modified sequence opt2 from anti-HIV_cap256-119-025355_VR-Chain
  source 1..432: mol_type = other RNA
gaggtccagctcgtcgagtccggcggcggcctcgtccagcccggccgctccctccgcctctcctgcgccgcctccggcttctccttctccgactacgccatgcactgggtccgccaggcccccggccagggcctcgagtgggtcgccttcatctcctacgacggcaccaagaagtaccactccgactccgtctggggccgcctcaccatctcccgcgacaactcccgcaacaccctcttcctccagatgaactccctccgcaccgaggacaccgccctctacttctgcgtccgcgaccagcgcgaggacgactgcgaggagtggtggtccgactactacgacttcggcaagaagctcccctgccgcaagtcccgcggcctcgccggcatcttcgacatctggggccacggcaccatggtcaccgtctcctcc

SEQ ID NO: 17234 - RNA, 432 nt, synthetic construct
  misc_feature 1..432: note = derived and/or modified sequence opt2 from anti-HIV_cap256-119-025301_VR-Chain
  source 1..432: mol_type = other RNA
caggtccacctcgtcgcctccggcggcggcgtcgtcccccccggccgctccctccgcctctcctgcgtcgcctcccagttcaccttctccggcttcggcctctactgggtccgccaggcccccggcaagggcctcgagtgggtcgccgccatctccttcgccggcaccaagaagcactacgccaactccgtcaagggccgcttcaccatctcccgcgacaactccaagaacaccctctacctccagatgaactccctccgccccgacgacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17235 - RNA, 438 nt, synthetic construct
  misc_feature 1..438: note = derived and/or modified sequence opt2 from anti-HIV_cap256-119-025010_VR-Chain
  source 1..438: mol_type = other RNA
caggtccagctcgtcgagtccggcggcggcgtcgtccagcccggccgctccctccgcctctcctgccccgcctccggcttctccttctccacctacggcatgcactgggtccgccaggcccccggcaagggcctcgagtgggtcgcctccatctccaacgacggcaacaagaagtaccacggcgagtccgtctgggaccgcttcaccatctcccgcgacaactccaagaacaccctcttcctccagatgaaccgcctccgcgtcgaggacaccgccctctacttctgcgtcaaggaccagcgcgaggacgagtgcgaggagtggtggtccgactactacgacttcggccgcgagctcccctgccgcaagttccgcggcctcggcctcgccggcatcttcgacgtctggggccacggcaccatggtcaccgtctcctcc

SEQ ID NO: 17236 - RNA, 432 nt, synthetic construct
  misc_feature 1..432: note = derived and/or modified sequence opt2 from anti-HIV_cap256-119-024631_VR-Chain
  source 1..432: mol_type = other RNA
caggtccagctcatggagtccggcggcggcgtcgtccagcccggcggctccctccgcctctcctgcgccgcctccggcttcaccttctcctcctacggcatgcactgggtccgccaggcccccggcaagggcctcgagtgggtcgccggcatctcctacgacggctccgacaagtaccacgcccacttcgtctggggccgcttcatcatctcccgcgacaactccaagaacgccctctacctccagatgaactccctccgccccgaggacaccgccctctacttctgcgtccgcgacctccgcgagtccgagtgcgaggagtggcagtcctactactacgacttcggccgcaagggcccctgcctcaagccccgcggcgtcgccggctccttcgacatctggggccagggcaccgtcgtcaccgtctcctcc

SEQ ID NO: 17237 - RNA, 432 nt, synthetic construct
  misc_feature 1..432: note = derived and/or modified sequence opt2 from anti-HIV_cap256-119-024467_VR-Chain
  source 1..432: mol_type = other RNA
gaggtccagctcgtcgagtccggcggcggcctcgtccagcccggcggctccctcaacgtctcctgcgccgcctccggcttcaccttccgcacctacgccatgcactgggtccgccaggcccccggcaagggcctcgagtgggtcgccgccatctcctacgacggcgacaacaagtactccgccgactccgtcaagggccgcttcaccatctcccgcgaccagtccaagaacaccctctacctccagatgaactccgtccgcgtcgaggacaccgcccgctactactgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17238 - RNA, 432 nt, synthetic construct
  misc_feature 1..432: note = derived and/or modified sequence opt2 from anti-HIV_cap256-119-023805_VR-Chain
  source 1..432: mol_type = other RNA
caggtccagctcgtcgagtccggcggcggcgtcgtccagcccggcaagtccctccgcctctcctgcgccgcctcccagttcggcttcggctcctacggcatgcactgggtccgccaggcccccggcaagggcctcgagtgggtcgccaccatctccttcgacggcgccgacaagtaccacgccgacgacgtctggggccgcttctccatctcccgcgacaactccaagaacaccctctacctccagatgaacaacctccgccccgaggacaccgccctctactactgcgccaaggacctccgcgaggacgagtgcgaggagcgctggtccgactactacgacttcggcaagcagctcccctgccgcaagtcccgcggcgtcgccggcgtcttcgacaactggggccagggcaccatggtcaccgtctcctcc

SEQ ID NO: 17239 - RNA, 432 nt, synthetic construct
  misc_feature 1..432: note = derived and/or modified sequence opt2 from anti-HIV_cap256-119-021736_VR-Chain
  source 1..432: mol_type = other RNA
caggtccagctcgtcgagtccggcggcggcgtcgtccagcccggccgctccgtccgcctctcctgcgtcgcctcccagttctccttcgaccgctacggcatgcactgggtccgccaggcccccggcaagggcctcgagtgggtcgcctccatctcctacgacggcaccgacaagtaccacgccgacaaggtctggggccgcttcaccatctcccgcgacaactccaagaagaccctctacctccagatgaactccctccgccccgaggacgccgccctctactactgcgccaaggacctccgcgaggacgagtgcgaggagtggtggtccgactactacgacttcggcaagcagctcccctgccgcaagtcccgcggcgtcgccggcatcttcgactcctggggccagggcaccatggtcaccgtctcctcc

SEQ ID NO: 17240 - RNA, 438 nt, synthetic construct
  misc_feature 1..438: note = derived and/or modified sequence opt2 from anti-HIV_cap256-119-021203_VR-Chain
  source 1..438: mol_type = other RNA
cagatgcagctcgtcgagtccggcggcggcgtcgtccagcccggccgctccctcaccctctcctgcgccgcctcccagttcaccttctccaactacggcatgcactgggtccgccaggcccccggcaagggcctcgagtgggtcgcctccgtctccaacgacggcaccaagaagtaccacggcgactccgtctgggaccgcttcaccatctcccgcgacaactccaagaacaccctcttcctccagatgtcctccctccgcgccgaggacaccgccgtctacttctgcgtccgcgacgagcgcgaggacgagtgcgaggagtggtggtccgactactacgacttcggccgcgagctcccctgccgcaagttccgcggcctcggcctcgccggcatcttcgacatctggggccacggcaccctcgtcaccgtctcctcc

SEQ ID NO: 17241 - RNA, 432 nt, synthetic construct
  misc_feature 1..432: note = derived and/or modified sequence opt2 from anti-HIV_cap256-119-020569_VR-Chain
  source 1..432: mol_type = other RNA
caggtccagctcgtcgagtccggcggcggcgtcgtccagcccggcgagtccctccgcatctcctgcgccgcctcccagttcaccttctcccgctacggcatgcactgggtccgccaggcccccggcaagggcctcgagtgggtcgcctccatctccttcgacggccgcgacaagtaccactcctccctcgtctggggccgcctcaccatctcccgcgacaactccaagtccaccctcttcctccagatgaactccctccgccccgaggacaccgccctctactactgcgcccgcgacgtccgcgagtccgagtgcgaggagtggcagtccgactactacgccttctaccgcaagctcccctgcgtcaagccccgcggcgtcgccggcaccctcgacatctggggccagggcaccatggtcaccgtctcctcc

SEQ ID NO: 17242 - RNA, 432 nt, synthetic construct
  misc_feature 1..432: note = derived and/or modified sequence opt2 from anti-HIV_cap256-119-019432_VR-Chain
  source 1..432: mol_type = other RNA
caggtccagctcgtccagtccggcggcggcgtcgtccagcccggccgctccctccgcatctcctgcgccgccccctacttcaccttcggccgctacggcttccactgggtccgccaggcccccggcaagggcctcgagtgggtcgcctccatctccttcgacggccgcgactactaccactccccccacgtctggggccgcctcaccatctcccgcgacaactccaagaacaccctctacctccagatgaactccctccgcgccgaggacaccgccctctactactgcgcccgcgacctccgcgagtccgagtgcgaggagtgggagtccgactactacgacttcggcaagaagggcccctgcgtcaagccccgcggcgtcgccggctccctcgacatgtggggccagggcaccatggtcaccgtctcctcc

SEQ ID NO: 17243 - RNA, 432 nt, synthetic construct
  misc_feature 1..432: note = derived and/or modified sequence opt2 from anti-HIV_cap256-119-018827_VR-Chain
  source 1..432: mol_type = other RNA
caggcccagctcgtcgagtccggcggcggcgtcgtccagcccggccgctccctccgcctctcctgcgccgcctcccacttctccttcaaccgctacggcatgcactgggtccgccaggcccccggcaagggcctcgagtgggtcgccggcatctcctacgacggccgcgacttctaccacgccgacatcgtctggggccgcctcaccatctcccgcgacaactccaagaacaccgtctacctccagatgaactccctccgcgccgacgacaccggcctctactactgcgcccgcgacgtccgcgagtccgagtgcgaggagtgggagtcctactactacgacttcggccgcaagggcccctgcctcaagccccgcggcgtcgccggcaccttcgacatgtggggccagggcaccatcgtctccgtctccgcc

SEQ ID NO: 17244 - RNA, 432 nt, synthetic construct
  misc_feature 1..432: note = derived and/or modified sequence opt2 from anti-HIV_cap256-119-018483_VR-Chain
  source 1..432: mol_type = other RNA
ctcgtccagctcgtcgagtccggcggcggcgtcgtccagcccggcaagtccctccgcctctcctgcgtcgcctcccagttcaccttcaaccgctacggcatgcactgggtccgccaggcccccggcaagggcctcgagtgggtcgccggcatctcctacgacggccgcgacaagtaccacgcccacttcgtctggggccgcatcaccatctcccgcgacaactccaagaacaccctctacctccagatgaactccctccgcgccgaggacaccgccctctaccactgcgtccgcgacctccgcgagtccgagtgcgagctctgggagtccgactactacgacttcggcaagaagctcccctgcgtcaagccccgcggcgtcgccggcatcttcgacctctggggccagggcaccatggtcaccgtctcctcc

SEQ ID NO: 17245 - RNA, 432 nt, synthetic construct
  misc_feature 1..432: note = derived and/or modified sequence opt2 from anti-HIV_cap256-119-018118_VR-Chain
  source 1..432: mol_type = other RNA
caggtccacctcgtcgcctccggcggcggcgtcgtcccccccggccgctccctcaccctctcctgcgtcgcctcccagttcaccttctccggctgcggcctccactgggtccgccaggcccccggcaagggcctcgagtgggtcgcctccatctccttcgccggcaccaagaagcactacggcaactccgtcaagggccgcttcaccatctcccgcgacaactccaagaacaccctctacctccagatgaactccctccgccccgaggacaccgccctctactactgcgccaaggacctccgcgagtacgagtgcgaggagtggacctccgactactacgacttcggccgcgaccagccctgcatcgactcccgcggcgtcgtcggcatcctcgacatctggggccagggcaccatggtcaccgtctcctcc

SEQ ID NO: 17246 - RNA, 432 nt, synthetic construct
  misc_feature 1..432: note = derived and/or modified sequence opt2 from anti-HIV_cap256-119-017782_VR-Chain
  source 1..432: mol_type = other RNA
caggtccagctcgtcgagtccggcggcggcgtcgtccagcccggcaagtccctccgcctctcctgcgccgcctccggcttccccttctccaactacgccatgcactgggtccgccagacccccggccgcggcctcgagtgggtcgccggcatctccttcgccgccaccaagaagtactaccgcccctccgtccgcggccgcttcaccgtctccaccgacatctccaagaacaccctctacctcgagatgaactccctccgccccgaggacaccgccctctacttctgcgcccgcgaccagcgctactacgagtgcgaggagtgggcctccgactactacgacttcggccgcgagcagccctgcctcgacccccgcggcgtcgtcggcatcttcgacctctggggccagggcaccatggtcaccgtctcctcc

SEQ ID NO: 17247 - RNA, 432 nt, synthetic construct
  misc_feature 1..432: note = derived and/or modified sequence opt2 from anti-HIV_cap256-119-017669_VR-Chain
  source 1..432: mol_type = other RNA
caggtccagctcgtcgagtccggcggcggcgtcgtccagcccggctcctccctccgcctctcctgcgccgcctcccacttcgccttcaaccgctacggcatgcactgggtccgccaggcccccggcaagggcctcgagtgggtcgccggcatctccttcgacggcgccgacaagttccacgccgacaaggtctggggccgcttcaccatctcccgcgacaactccaagaacaccctctccctccagatgaactccctccgccccgaggacaccgccctctactactgcgccaaggacctccgcgaggacgagtgcgaggagtggtggtccgactactacgacttcggccgccgcctcccctgccgcaagtcccgcggcgtctccggcatcttcgacaactggggccagggcaccatggtcaccgtctcctcc

SEQ ID NO: 17248 - RNA, 432 nt, synthetic construct
  misc_feature 1..432: note = derived and/or modified sequence opt2 from anti-HIV_cap256-119-016976_VR-Chain
  source 1..432: mol_type = other RNA
caggtccagctcgtcgagtccggcggcggcgtcgtccagcccggccgctccctccgcctctcctgcgccgcctcccagttctccttcggcgacttcggcatgcactgggtccgccaggcccccggcaagggcctcgagtgggtcgccgccatctccttcgccggcaccaagaagaactacgccgactccgtccgcggccgcttcaccatctcccgcgactcctccaagaacaccctctacctccagatgaactccctccgccccgaggacaccgccctctactactgcgtcaaggacatgcgcggctacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17249 - RNA, 432 nt, synthetic construct
  misc_feature 1..432: note = derived and/or modified sequence opt2 from anti-HIV_cap256-119-015432_VR-Chain
  source 1..432: mol_type = other RNA
gaggtccagctcctcgagtccggcggcggcctcgtccagcccggcggctccctccgcctctcctgcgccgcctccggcttcaccttctccggctactccctcaactgggtccgccaggcccccggcaagggcctcgagtgggtcgcctccatctcctacgacggctccgacaagtaccacgccgaccgcgtctggggccgcttcaccatctcccgcgacaactccaagaacaccctctacctccagatgaactccctccgcgccgaggacaccgccctctactactgcgtccgcgacgcccgcgagtccgagtgcgagctctgggagtccgactactacaacttcggccgcaagctcccctgcgtcaagccccgcggcgtcgccggcaccctcgacatctggggccagggcaccatggtcaccgtctcctcc

SEQ ID NO: 17250 - RNA, 432 nt, synthetic construct
  misc_feature 1..432: note = derived and/or modified sequence opt2 from anti-HIV_cap256-119-015281_VR-Chain
  source 1..432: mol_type = other RNA
ctcggccgcctcgtcgcctccggcggcggcgtcgtcccccccggccgctccctccgcctctcctgcgtcgcctcccagttcaccttctccggctgcggcctccactgggtccgccaggcccccggcaagggcctcgagtgggtcgcctccatctccttcgccggcaccaagaagcactacggcaactccgtcaagggccgcttcaccatctcccgcgacaactccaagaacaccgtctacctcgagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggggccagggcaccatggtcaccgtctcctcc

SEQ ID NO: 17251 - RNA, 432 nt, synthetic construct
  misc_feature 1..432: note = derived and/or modified sequence opt2 from anti-HIV_cap256-119-014957_VR-Chain
  source 1..432: mol_type = other RNA
caggtccaggtcgtcgagtccggcggcggcgtcgtccagcccggcacctccctccgcctctcctgcaccgtctccggcttctccttctccaactacgacctccactgggtccgccagacccccgccaagggcctcgagtgggtcgccgtcgtctcctacgacggctcccgcgagtactacaccgactccgtcaagggccgcttcatcatctcccgcgaccagtccaagaacaccctctacctccagatgaactccgtccgcctcgaggacaccgcccgctactactgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17252 - RNA, 432 nt, synthetic construct
  misc_feature 1..432: note = derived and/or modified sequence opt2 from anti-HIV_cap256-119-014777_VR-Chain
  source 1..432: mol_type = other RNA
caggtccacctcgtcgagtccggcggcggcgtcgtccagcccggccgctccctccgcctctcctgcgccgcctcccacttctccctctcctcctacggcatgcactgggtccgccaggcccccggcaagggcctcgagtgggtcgccggcatctccttcgccgccaccaagacctactacggcggctccgtcaagggccgcttcaccgtctcccgcgacatctccaagaacaccctctacctccagatgaactccctccgccccgaggacaccgccatgtactactgcgcccgcgaccagcgctactacgagtgcgaggagtgggcctccgactactacgacttcggccgcgagcagccctgccaggacccccgcggcgtcgtcggcgtcttcgacatgtggggccagggcaccatggtcaccgtctcctcc

SEQ ID NO: 17253 - RNA, 432 nt, synthetic construct
  misc_feature 1..432: note = derived and/or modified sequence opt2 from anti-HIV_cap256-119-014313_VR-Chain
  source 1..432: mol_type = other RNA
caggtccagctcgtcgagtccggcggcggcgtcgtccagcccggccgctccctccgcatctcctgcgccgcctcccagttcaccttctcccgctacggcatgcactgggtccgccaggcccccggcaagggcctcgagtgggtcgcctccatctcctacgacggccgcgactaccaccacgccggcgccgtctggggccgcttcatcatctcccgcgacaactccaagaactccctccacctccagatgaactccctccgccccgaggacaccgccctctacttctgcgcccgcgacctccgcgagtccgagtgcgaggagtgggagtccgactactacaacttctggaagaagctcccctgcgtcaagccccgcggcgtcgtcggcatcctcgacatctggggccagggcaccgtcgtcaccgtctcctcc

SEQ ID NO: 17254 - RNA, 438 nt, synthetic construct
  misc_feature 1..438: note = derived and/or modified sequence opt2 from anti-HIV_cap256-119-014219_VR-Chain
  source 1..438: mol_type = other RNA
cagatgcagctcgtcgagtccggcggcggcgtcgtccagcccggctcctccctcaccctctcctgcgccgcctcccagttcaccttctccaactacggcatgcactgggtccgccaggcccccggcaagggcctcgagtgggtcgcctccatctccaacgacggcaccaagaagtaccacggcgactccgtctgggaccgcttcaccatctcccgcgacaactccaagaacaccctcttcctccagatgaactccctccgcgccgaggacaccgccctctacttctgcgtcaaggaccagcgcgaggacgagtgcgaggagtggtggtccgactactacgacttcggccgcgagctcccctgccgcaagttccgcggcctcggcctcgccggcaccttcgacatctggggccacggcaccatgctcatcgtctcctcc

SEQ ID NO: 17255 - RNA, 432 nt, synthetic construct
  misc_feature 1..432: note = derived and/or modified sequence opt2 from anti-HIV_cap256-119-013631_VR-Chain
  source 1..432: mol_type = other RNA
caggtccagctcgtcgagtccggcggcggcgtcgtccagcccggccgctccctccgcctctcctgcgccgcctcccagttcaccttcggctcctacggcatgcactgggtccgccagatccccggcaagggcctcgagtgggtcgccaccatctcctacgacggcaccaagaagtaccacgccgactccgtctgggaccgcttcatcatctcccgcgacaactccaagaacaccctcttcctccagatgaactccctccgccccgaggacaccgccctctacttctgcgtcaaggaccagcgccaggacgagtgcgaggagtggtggtccgactactacgacttcggccgccgcctcccctgccgcaagtcccgcggcctcgccggcatcttcgacgtctggggccacggcaccatggtcaccgtctcctcc

SEQ ID NO: 17256 - RNA, 432 nt, synthetic construct
  misc_feature 1..432: note = derived and/or modified sequence opt2 from anti-HIV_cap256-119-012924_VR-Chain
  source 1..432: mol_type = other RNA
caggtcaccctcgtcgagtccggcggcggcttcgtccagcccggcggctccctccgcctctcctgcgccacctccggcttcaccttctcctcctacgccatgcactgggtccgccaggcccccggcaagggcctcgagtgggtcgccgccatctccttcgacggcgccgacaagtaccacgccgacaacgtctggggccgcctctccatctcccgcgacaactccaagtccaccctctacctccagatgaactccctccgccccgaggacaccgccgtctacttctgcgccaaggacctccgcgaggacgagtgcgaggagcgctggtccgactactacgacttcggcaagcagctcccctgccgcaagtcccgcggcgtcgccggcatcttcgacaactggggccagggcaccatggtcaccgtctccgcc

SEQ ID NO: 17257 - RNA, 432 nt, synthetic construct
  misc_feature 1..432: note = derived and/or modified sequence opt2 from anti-HIV_cap256-119-011793_VR-Chain
  source 1..432: mol_type = other RNA
caggtccagctcgtcgagtccggcggcggcgtcgtccagcccggcggctccctccgcctctcctgcgtcgcctcccagttcaccttctcccgctacggcatgcactgggtccgccaggcccccggcaagggcctcgagtgggtcgcctccatctcctacgacggccgcgacaagtaccacgccgacttcgtctggggccgcctcaccatctcccgcgacgactccaagaagaccctctacctccagatggactccctccgcgtcgacgacaccgccctctactactgcgtccgcgacatgcgcgagtccgagtgcgagctctgggagtccgactactacgacttcggcaagcgcctcccctgcgtcaagccccgcggcgtcgccggcatcttcgacatctggggccagggcaccatggtcaccgtctcctcc

SEQ ID NO: 17258 - RNA, 432 nt, synthetic construct
  misc_feature 1..432: note = derived and/or modified sequence opt2 from anti-HIV_cap256-119-011413_VR-Chain
  source 1..432: mol_type = other RNA
caggtccagctcgtcgagtccggcggcgacgtcgtccagcccggccgctccctccgcctctcctgcgccgcctccggcttcaccttctccacctacggcatgcactgggtccgccaggcccccggcaagggcctcgagtgggtcgccgccatctccttcgccggcaccaagaagaactacgccgactccgtccgcggccgcttcaccatctcccgcgactcctccaagaacaccctctacctcgagatgaactccctccgccccgaggacaccgccctctactactgcgccaaggacatgcgcggctacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17259 - RNA, 432 nt, synthetic construct
  misc_feature 1..432: note = derived and/or modified sequence opt2 from anti-HIV_cap256-119-011323_VR-Chain
  source 1..432: mol_type = other RNA
caggtcaagctcgtcgagtccggcggcggcgtcgtcccccccggcaagtccctccgcctctcctgcaccgcctcccagttcaccttctccaacttcggcatgcactgggtccgccaggcccccggcaagggcctcgagtgggtcgcctccatctccttcgtcggcatcaagacccactacgccaactccgtccgcggccgcttcaccatctcccgcgaccagtccaagaacaccctctacctccagatgaactccgtccgcgtcgaggacaccggccgctactactgcgcccgcgacatgcgcgagtacgagtgcgagctctgggcctccgactactacgacttcggcaagccccagccctgcgaggacccccgcggcgtcgtcggcaccttcgacatgtggggcctcggcaccctcgtcaccgtctcctcc

SEQ ID NO: 17260 - RNA, 432 nt, synthetic construct
  misc_feature 1..432: note = derived and/or modified sequence opt2 from anti-HIV_cap256-119-011233_VR-Chain
  source 1..432: mol_type = other RNA
caggtccacctcgtcgagtccggcggcggcgtcgtccagcccggccgctccgtccgcctctcctgcgccgcctcccacttctccctctcctcctacggcatgcactgggtccgccaggcccccggcaagggcctcgagtgggtcaccggcatctccttcgccggcaccaagacctactacggcgactccgtccgcggccgcttcaccgtctcccgcgacatctccaagaacaccctcttcctccagatgaactccctccgccccgacgacaccgccatgtactactgcgcccgcgaccagcgctactacgagtgcgaggagtgggcctccgactactacgacttcggccgcgagcagccctgcctcgacccccgcggcgtcgtcggcatcttcgacctctggggccagggcaccatggtcaccgtctcctcc

SEQ ID NO: 17261 - RNA, 432 nt, synthetic construct
  misc_feature 1..432: note = derived and/or modified sequence opt2 from anti-HIV_cap256-119-009038_VR-Chain
  source 1..432: mol_type = other RNA
caggagcagctcgtcgagtccggcggcggcgtcgtccagcccggccgctccctccgcctctcctgcgtcgcctcccgcttcaccttctccgccttcggcatgcactgggtccgccaggcccccggcaagggcctcgagtgggtcgcctccatctccttcgccggcatcaagaagtactacggcgactccgtcaagggccgcttcaccatctcccgcgacaactccaagaacaccctctacctccagatggacggcctccgcggcgaggacaccgccctctactactgcgccaaggacctccgcgagctcgagtgcgaggagtgggcctccgactactacgacttcggccgcccccagccctgcctcgacccccgcggcgtctccggcatctccaacgtctggggccagggcaccatggtcaccgtctcctcc

SEQ ID NO: 17262 - RNA, 432 nt, synthetic construct
  misc_feature 1..432: note = derived and/or modified sequence opt2 from anti-HIV_cap256-119-008756_VR-Chain
  source 1..432: mol_type = other RNA
caggtccagctcgtcgagtccggcggcggcgtcgtccagcccggcaagtccctccgcctctcctgcgtcgtctcccagttcaccttcggccgctacggcatgcactgggtccgccaggcccccggcaagggcctcgagtgggtcgcctccatctcctacgacggctccgacaagtaccacacctcctccctctggggccgcttcatcgtctcccgcgacaactccaagaacaccctctacctccagatgaactccctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17263 - RNA, 438 nt, synthetic construct
  misc_feature 1..438: note = derived and/or modified sequence opt2 from anti-HIV_cap256-119-008055_VR-Chain
  source 1..438: mol_type = other RNA
cagatgcagctcgtcgagtccggcggcggcgtcgtccagcccggccgctccctcaccctctcctgcgccgcctcccagttctccttcgccaactacggcatgcactgggtccgccaggcccccggcaagggcctcgagtgggtcgcctccatctccaacgacggcaccaagaagtaccacgaggagtccgtctggggccgcttcaccatctccaaggacaactccaagaacaccctcttcctccagatgaactccctccgcatcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17264 - RNA, 435 nt, synthetic construct
  misc_feature 1..435: note = derived and/or modified sequence opt2 from anti-HIV_cap256-119-006949_VR-Chain
  source 1..435: mol_type = other RNA
caggtccacctcgtcgagtccggcggcggcgtcgtccagcccggccgctccctccgcctctcctgcgccgcctccggcttctccgtctccaacaactacatgaactgggtccgccaggcccccggcgagggcctcgagtgggtcgccctcatctccttcgacggccgccagaaggacctcgccgactccgtcaagggccgcttcgccatctcccgcgacaactccaagaacaccctctacctccagatgaactccctccgcctcgaggacaccgccctctactactgcgcccgcgacctccgcgagctcgactgcgaggagtggaccctctacaactactacgacttcggctcccgcggcccctgcgtcgacccccgcggcgtcggcggctccttcgacgtctggggccagggcaccatggtcaccgtctcctcc

SEQ ID NO: 17265 - RNA, 432 nt, synthetic construct
  misc_feature 1..432: note = derived and/or modified sequence opt2 from anti-HIV_cap256-119-006685_VR-Chain
  source 1..432: mol_type = other RNA
caggtccagctcgtcgagtccggcggcggcgtcgtccagcccggccgctccctccgcgtctcctgcgccgcctcccacttcaccttctcccgctacggcatgcactgggtccgccaggcccccggcaagggcctcgagtgggtcgcctccatctcctacgacggccgcgacttctaccacgcccgctccgtctggggccgcttcaccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17266 - RNA, 432 nt, synthetic construct
  misc_feature 1..432: note = derived and/or modified sequence opt2 from anti-HIV_cap256-119-006015_VR-Chain
  source 1..432: mol_type = other RNA
caggtccagctcgtcgagtccggcggcggcgtcgtccagcccggcaagtccctccgcctctcctgcgccgcctcccgcttcaccttcaaccgctacggcatgcactgggtccgccaggcccccggcaagggcctcgagtgggtcgccgccatctccttcgacggcaccgacaagtaccactccgacgacgtctggggccgcttcaccatctcccgcgacaactccaagaacaccctctacctccagatgaactccctccgccccgaggacaccgccctctactactgcgccaaggacctccaggaggacgagtgcgaggagtggtggtccgactactacgacttcggcaagcagctcccctgccgcaagtcccgcggcgtcgccggcatcttcgacgactggggccagggcaccatggtcaccgtctcctcc

SEQ ID NO: 17267 - RNA, 432 nt, synthetic construct
  misc_feature 1..432: note = derived and/or modified sequence opt2 from anti-HIV_cap256-119-005841_VR-Chain
  source 1..432: mol_type = other RNA
caggtccagctcgtcgagtccggcggcggcgtcgtccagcccggccgctccctccgcctctcctgcgccgcctcccagttctccttcggcaacttcggcatgcactgggtccgccaggcccccggcaagggcctcgagtgggtcgccgccatctccttcgccggcaccaaggagaactacgccaactccgtccgcggccgcttcaccatctcccgcgacaactccaagaacaccctctacctccagatgaactccctccgcgccgaggacaccgccctctactactgcaccaaggacatgcgcgagtacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17268 - RNA, 432 nt, synthetic construct
  misc_feature 1..432: note = derived and/or modified sequence opt2 from anti-HIV_cap256-119-005824_VR-Chain
  source 1..432: mol_type = other RNA
caggtccagctcgtcgagtccggcggcggcgtcgtccagcccggcggctccctccgcctctcctgcgccgcctccggcttcaccttccgccgctacgccatgcactgggtccgccaggcccccggcaagggcctcgagtgggtcgcctccatctcctacgacggctccgacaagtaccacacctcctccctctggggccgcttcatcgtctcccgcgacaactccaagaacaccctctacctccagatgaactccctccgccccgaggacaccgccctctactactgcgtccgcgaccgccgcgagtccgagtgcgaggagcgctggtccgactactacgacttcggcaagcagctcccctgcgtcaagccccgcggcgtcgccggcatcttcgacatctggggccagggcaccatggtcaccgtctcctcc

SEQ ID NO: 17269 - RNA, 432 nt, synthetic construct
  misc_feature 1..432: note = derived and/or modified sequence opt2 from anti-HIV_cap256-119-005494_VR-Chain
  source 1..432: mol_type = other RNA
caggtccgcctcgtcgagtccggcggcggcgtcgtccagcccggccgctccctccgcatctcctgcgccgcctcccagttcatgttcaacaagtacggcatgcactgggtccgccaggcccccggcaagggcctcgagtgggtcgcctccatctcctacgacggctccgacaagtaccacgccgacctcgtctggggccgcttcaccatctcccgcgacaactccaagaacaccctctacctccagatgaactccctccgcgccgaggacaccgccctctactactgcgtccgcgacgcccgcgagtccgagtgcgagctctgggagtccgactactacaacttcggccgcaagctcccctgcgtcaagccccgcggcgtcgccggcaccctcgacatctggggccagggcaccatggtcaccgtctcctcc

SEQ ID NO: 17270 - RNA, 432 nt, synthetic construct
  misc_feature 1..432: note = derived and/or modified sequence opt2 from anti-HIV_cap256-119-004949_VR-Chain
  source 1..432: mol_type = other RNA
caggtccagctcgtcgagtccggcggcggcgtcgtccagcccggccgctccctccgcctctcctgcgccgcctccaagttctccctctcctcctacggcatgcactgggtccgccaggcccccggccgcggcctcgagtgggtcgccggcatctccttcgccgccaccaagaagtactaccgcccctccgtccgcggccgcttcaccgtctccaccgacatctccaagaacaccctctacctcgagatgaactccctccgccccgaggacaccgccctctacttctgcgcccgcgaccagcgctactacgagtgcgaggagtgggcctccgactactacgacttcggccgcgagcagccctgcctcgacccccgcggcgtcgtcggcatcttcgacctctggggccagggcaccatggtcaccgtctcctcc

SEQ ID NO: 17271 - RNA, 432 nt, synthetic construct
  misc_feature 1..432: note = derived and/or modified sequence opt2 from anti-HIV_cap256-119-004422_VR-Chain
  source 1..432: mol_type = other RNA
cacgtccagctcgtcgagtccggcggcggcgtcgtccagcccggccgctccctccgcctctcctgcgccgcctccggcctctccttctcctcctacgccatgcactgggtccgccaggcccccggcaagggcctcgagtgggtcgccgtcgtctcctacgacggcaccaccaagttctacgccgactccgtcaagggccgcttcaccatctcccgcgacaactccaagaacaccctctacctccagatgaactccctccgcggcgaggacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17272 - RNA, 432 nt, synthetic construct
  misc_feature 1..432: note = derived and/or modified sequence opt2 from anti-HIV_cap256-119-003932_VR-Chain
  source 1..432: mol_type = other RNA
caggtccagctcctcgagtccggcggcggcgtcgtccagcccggcggctccctccgcctctcctgcaaggcctcccacttctccttcgaccgctacggcatgcactgggtccgccaggcccccggcaagggcctcgagtgggtcgccgccatctccttcgacggcgccgacaagtaccacgccgacaacgtctggggccgcctctccatctcccgcgacaactccaagtccaccctctacctccagatgaactccctccgccccgaggacaccgccgtctacttctgcgccaaggacctccgcgaggacgagtgcgaggagcgctggtccgactactacgacttcggcaagcagctcccctgccgcaagtcccgcggcgtcgccggcatcttcgacaactggggccagggcaccatggtcaccgtctccgcc

SEQ ID NO: 17273 - RNA, 438 nt, synthetic construct
  misc_feature 1..438: note = derived and/or modified sequence opt2 from anti-HIV_cap256-119-003577_VR-Chain
  source 1..438: mol_type = other RNA
caggtccagctcgtcgagtccggcggcggcggcgtccagcccggccgctccctccgcctctcctgcgccgcctccggcttcaccttccgctcctacgccatgcactgggtccgccaggcccccggcaagggcctcgagtgggtcgccgtcatctccaacgacggcaccaagaagtaccacgccgagtccgtctgggaccgcttctccatctccaaggacaactccaagaacaccctcttcctccagatgaactccctccgcgtcgaggacaccgccctctacttctgcgtcaaggaccagcgcgaggacgagtgcgaggagtggtggtccgactactacgacttcggccgcgagctcccctgccgcaagtcccgcggcctcggcctcgccggcatcttcgacatgtggggccacggcaccatggtcaccgtctcctcc

SEQ ID NO: 17274 - RNA, 432 nt, synthetic construct
  misc_feature 1..432: note = derived and/or modified sequence opt2 from anti-HIV_cap256-119-002155_VR-Chain
  source 1..432: mol_type = other RNA
ctcggccgcctcgtcgcctccggcggcggcgtcgtcccccccggccgctccctccgcctctcctgcgtcgcctcccagttcaccttctccggctgcggcctccactgggtccgccaggtccccggcaagggcctcgagtgggtcgcctccatctccttcgccggcaccaagacccactacggcaactccgtcaagggccgcttctccatctcccgcgacaactccatcaacaccgtctacctccagatgaactccctccgcgccgaggacaccgccctctactactgcgccaaggacctccgcgagtacgagtgcgaggagtggacctccgactactacgacttcggccgcccccagccctgcatcgactcccgcggcgtcgtcggcatcctcgacatctggtcccagggcaccatggtcaccgtctcctcc

SEQ ID NO: 17275 - RNA, 432 nt, synthetic construct
  misc_feature 1..432: note = derived and/or modified sequence opt2 from anti-HIV_cap256-119-002017_VR-Chain
  source 1..432: mol_type = other RNA
caggtccagctcgtcgagtccggcggcggcgtcgtccagcccggccgctccctccgcctctcctgcgccgcctccggcttcaccttctcctactacggcatccactgggtccgccaggcccccggcaagggcctcgagtgggtcgcctccatctcctacgacgagcgcgacttctaccacgcccgctccgtctggggccgcttcgccatctcccgcgacaactccaagaacaccctccacctccagatgaactccctccgccccgaggacaccgccctctacttctgcgcccgcgacctccgcgagtccgagtgcgaggagtgggagtcctactactacgacttcggcaagaagggcccctgcgtcaagccccgcggcgtcgtcggcgtcctcgacatctggggccagggcaccctcgtcaccgtctcctcc

SEQ ID NO: 17276 - RNA, 432 nt, synthetic construct
  misc_feature 1..432: note = derived and/or modified sequence opt2 from anti-HIV_cap256-119-001312_VR-Chain
  source 1..432: mol_type = other RNA
caggtccagctcatggagtccggcggcggcgtcgtccagcccggccgctccctccgcctcgcctgcgccgcctccggcttcaccttctcctcctacgccatccactgggtccgccaggcccccggcaagggcctcgagtgggtcgccgccatctccttcgccggcaccaagaagaactacgccgactccgtccgcggccgcttcaccatctcccgcgactcctccaagaacaccctctacctcgagatgaactccctccgccccgaggacaccgccctctactactgcgccaaggacatgcgcggctacgagtgcgaggagtggacctccgactactacgacttcggccgcccccagccctgcatcgactcccgcggcgtcgtcggcaccttcgacgtctggggccagggcaccatggtcaccgtctcctcc

SEQ ID NO: 17277 - RNA, 438 nt, synthetic construct
  misc_feature 1..438: note = derived and/or modified sequence opt2 from anti-HIV_cap256-119-001017_VR-Chain
  source 1..438: mol_type = other RNA
cagatgcagctcgtcgagtccggcggcggcgtcgtccagcccggccgctccctcaccctctcctgcgccgcctcccagttctccttcaccaactacggcatgcactgggtccgccaggcccccggcaagggcctcgagtgggtcgcctccatctccaacgacggcaacaagaagtaccacggcgagtccgtctgggaccgcttcaccatctcccgcgacaactccaagaacaccctcttcctccagatgaaccgcctccgcgtcgaggacaccgccctctacttctgcgtcaaggaccagcgcgaggacgagtgcgaggagtggtggtccgactactacgacttcggccgcgagctcccctgccgcaagttccgcggcctcggcctcgccggcatcttcgacgtctggggccacggcaccatggtcaccgtctcctcc

SEQ ID NO: 17278 - RNA, 432 nt, synthetic construct
  misc_feature 1..432: note = derived and/or modified sequence opt2 from anti-HIV_cap256-119-000594_VR-Chain
  source 1..432: mol_type = other RNA
caggtccagctcgtcgagtccggcggcggcctcgtccagcccggcacctccctccgcctctcctgcgccgcctccgccttcaccttcaagaactacggcatgcactgggtccgccaggcccccggcaagggcctcgactgggtcgcctccatctcctacgacggccgcgacaagtaccactcctccctcgtctggggccgcctcaccatctcccgcgacaactccaagtccaccctcttcctccagatgaactccctccgcgccgaggacaccgccctctactactgcgcccgcgacctccgcgagtccgagtgcgaggagtggcagtccgactactacgccttctacaagaagctcccctgcgtcaagccccgcggcgtcgccggcaccctcgacatctggggccagggcaccatggtcaccgtctcctcc

SEQ ID NO: 17279 - RNA, 432 nt, synthetic construct
  misc_feature 1..432: note = derived and/or modified sequence opt2 from anti-HIV_cap256-059-241099_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctcctacgacggctccaacaagtactacgtcgactccgtccagggccgcttcaccatctcccgcgacaactccaagaacaccatgttcctccagatgaactccctccgcaccgaggacaccgccgtctactactgcgcccgcgacctcggcgagtccgaggtcgaggagtgggccaccgactactacgacttctccatcgcctaccccgtcgagggcccccgcggcgtcgtcggcatcttcgacatctggggccagggcaccatggtcaccgtctcctcc

SEQ ID NO: 17280 - RNA, 432 nt, synthetic construct
  misc_feature 1..432: note = derived and/or modified sequence opt2 from anti-HIV_cap256-059-207529_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccggcatctccttcgccggcatcaacaagtactacggcaactccgtcaagggccgcttcaccatctcccgcgacaactcccgcaacaccctctacctccagatgaactccctccgcgccgaggacaccgccctctactactgcgcccgcgacctccgcgagatggagtgcgaggagtgggcctccgactactacgacttcggccgcggcggcccctgccaggacccccgcggcgtcgtcggcaccttcgacatctggggccagggcaccatggtcaccgtctcctcc

SEQ ID NO: 17281 - RNA, 435 nt, synthetic construct
  misc_feature 1..435: note = derived and/or modified sequence opt2 from anti-HIV_cap256-059-205541_VR-Chain
  source 1..435: mol_type = other RNA
cagatgcagctcgtcgagtccggcggcggcgtcgtccagcccggcggctccctccgcctctcctgcgccgcctccggcttctccttctcctactacgccatggactgggtccgccaggcccccggcaagggcctcgagtgggtcgccttcatctcctccgacggctccgacaagaactacgccgactccgtcaagggccgcttcaccatctcccgcgacaactccaagaacaccctctacctccagatgaactccctccgcgccgaggacaccgccgtctactactgcgccaaggacgtcggcggccacaagaacgacgagtgggccaccaactactactacgacatctccatcgcctaccccatccaggacccccgcgccgtcgccggcgccttcgacgtctggggccagggcaccatggtcaccgtctcctcc

SEQ ID NO: 17282 - RNA, 432 nt, synthetic construct
  misc_feature 1..432: note = derived and/or modified sequence opt2 from anti-HIV_cap256-059-188439_VR-Chain
  source 1..432: mol_type = other RNA
caggtccagctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgccgccatctccttcgccggcatcaacaagtactacaccgactccgtcaagggccgcttcaccatctcccgcgacaactccaagaacaccctctacctccagatgaactccctccgcgccgaggacaccgccctctactactgcgccaaggacctccgcggcttcgagtgcgaggagtgggcctccgactactacgacttcggccgcgacctcccctgccaggacccccgcggcgtcgtcggcaccttcgacgtctggggccagggcaccaaggtcaccgtctcctcc

SEQ ID NO: 17283 - RNA, 432 nt, synthetic construct
  misc_feature 1..432: note = derived and/or modified sequence opt2 from anti-HIV_cap256-059-187234_VR-Chain
  source 1..432: mol_type = other RNA
caggtccagctcgtcgagtccggcggcggcgtcgtccaggccggccgctccctccgcctctcctgcgccgcctcccagttcaccttcggctcctacggcatgcactgggtccgccaggcccccggcaagggcctcgagtgggtcgccgccatctccttcgccggcaccaagatccactacgccgactccgtcaagggccgcttcaccatctcccgcgacaactccaagaacgccctctacctccagatgcactccctccgcgccgaggacaccgccctctactactgcgccaaggacctccgcgagtacgagtgcgaggagtgggcctccgactactacgacttcggccgcgaccagccctgccaggacccccgcggcgtcgtcggcatcttcgacatctggggccagggcaccatggtcaccgtctcctcc

SEQ ID NO: 17284 - RNA, 432 nt, synthetic construct
  misc_feature 1..432: note = derived and/or modified sequence opt2 from anti-HIV_cap256-059-187047_VR-Chain
  source 1..432: mol_type = other RNA
caggtccagctcgtcgagtccggcggcggcgtcgtccagcccggccgctccctccgcctctcctgcgccgtctcccagctcaccttctcctcctacggcatgcactgggtccgccaggcccccggcaagggcctcgagtgggtcgccgccatctccttcgtcggcatcaagaagtactacgccgactccgtcaagggccgcttcaccatctcccgcgacaactccaagaacaccctctacctccagatgaactccctccgcgtcgaggacaccgccctctactactgcgccaaggacctccgcgagtacgagtgcgaggagtgggcctccgactactacgacttcggccgcgaccagccctgccaggacgcccgcggcgtcgtcggcacctccgacatctggggccagggcaccatggtcaccgtctcctcc

SEQ ID NO: 17285 - RNA, 432 nt, synthetic construct
  misc_feature 1..432: note = derived and/or modified sequence opt2 from anti-HIV_cap256-059-186068_VR-Chain
  source 1..432: mol_type = other RNA
caggtccagctcgtcgagtccggcggcggcgtcgtccagcccggccgctccctccgcctctcctgcgccgcctcccagttctccttctccaactacggcatgcactgggtccgccaggcccccggcaagggcctcgagtgggtcgccggcatctccttcgccgccaccaagaagtactacgccgactccgtcaagggccgcttctccgtctcccgcgacaactccaagaacgccctctacctccagatgaactccctccgcgccgaggacaccgccctctactactgcgcccgcgacctccgcgactacgagtgcgaggagtgggcctccgactactacgacttcggccgcgagtacccctgccaggacccccgcggcgtcgtcggcaccttcgacatctggggccagggcaccatggtcaccgtctccacc

SEQ ID NO: 17286 - RNA, 435 nt, synthetic construct
  misc_feature 1..435: note = derived and/or modified sequence opt2 from anti-HIV_cap256-059-182835_VR-Chain
  source 1..435: mol_type = other RNA
caggtccagctcgtcgagtccggcggcggcctcgtccagcccggccgctccctccgcctctcctgcgccgcctccggcttctccttcaacaacttcgccatggactgggtccgccaggcccccggcaagggcctcgagtgggtcgccttcgtctcctccgacggctccaacaagaactacgccgactccgtcaagggccgcttcatcatctcccgcgacaactccaagaacaccgtctacctccagatgaactccctccgcgtcgaggacaccgccgtctactactgcgccaaggacctcggcgccaacaaggacgacgagtgggccaccgactactactacgacctctccgtcgcccgccccgtccccgacccccgcgccgtcgtcggcgccttcgacgtctggggccagggcaccatggtcaccgtctcctcc

SEQ ID NO: 17287 - RNA, 432 nt, synthetic construct
  misc_feature 1..432: note = derived and/or modified sequence opt2 from anti-HIV_cap256-059-176659_VR-Chain
  source 1..432: mol_type = other RNA
cgcgtccagctcgtcgagtccggcggcggcgtcgtccagcccggccgctccctccgcctctcctgcgccgcctcccagttctccttctccaactacggcatgcactgggtccgccaggcccccggcaagggcctcgagtgggtcgccggcatctccttcgccgccatcaagaagtactacgccgactccgtcaagggccgcttcaccatctcccgcgacaactccaagaacgccctctacctccagatgaactccctccgcgccgaggacaccgccctctactactgcgcccgcgacctccgcgagtacgagtgcgaggagtgggcctccgactactacgacttcggccgcgagctcccctgccaggacccccgcggcgtcgtcggcaccttcgacacctggggccagggcaccatggtcaccgtctccacc

SEQ ID NO: 17288 - RNA, 432 nt, synthetic construct
  misc_feature 1..432: note = derived and/or modified sequence opt2 from anti-HIV_cap256-059-172956_VR-Chain
  source 1..432: mol_type = other RNA
caggtccagctcgtcgagtccggcggcggcgtcgtccagcccggccgctccctccgcctctcctgcgccgcctcccagttctccttctcctcctacggcatgcactgggtccgccaggcccccggcaagggcctcgagtgggtcgccgccatgtccttcgccggcaccaaccagtactacgccgcctccgtcaagggccgcttcaccatctcccgcgacaactccaagaacaccctctacctccacatgaactccctccgccccgaggacaccgccctctactactgcgcccgcgacctccgcgagtacgagtgcgaggagtgggccgccgactactacgacttcggccgcgagtacccctgccaggacccccgcggcgtcgtcggcatcttcgacgtctggggccagggcaccctcgtcaccgtctcctcc

SEQ ID NO: 17289 - RNA, 432 nt, synthetic construct
  misc_feature 1..432: note = derived and/or modified sequence opt2 from anti-HIV_cap256-059-171272_VR-Chain
  source 1..432: mol_type = other RNA
caggtcctcctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgccgccatctccttcgccggcatgaagaagtactacgccgactccgtcaagggccgcttcaccatctcccgcgacaactccaagaacaccctctacctccagatgaactccctccgcgccgaggacaccgccctctactactgcgccaaggacctccgcgagttcgagtgcgaggagtgggcctccgactactacgacttcggccgcgcccagccctgccaggacccccgcggcgtcgtcggcaccttcgacctctggggccagggcaccatggtcaccgtctcctcc

SEQ ID NO: 17290 - RNA, 432 nt, synthetic construct
  misc_feature 1..432: note = derived and/or modified sequence opt2 from anti-HIV_cap256-059-168734_VR-Chain
  source 1..432: mol_type = other RNA
caggtccagctcgtcgagtccggcggcggcgtcgtccagcccggccgctccctccgcctctcctgcaccgcctcccagttctccttctcctcctacggcatgcactgggtccgccaggcccccggcaagggcctcgagtgggtcgccgccatctccttcgccggcaccaagaagtactacgtcggcaccgtcaagggccgcttcaccatctcccgcgacaactccaagaacaccctctacctccagatgaactccctccgcgccgaggacaccgccctctactactgcgccaaggacatgcgcgagtacgagtgcgaggagtgggcctccgactactacgacttcggccgcgagtacccctgccaggacccccgcggcgtcgtcggcaccttcgacatctggggccagggcaccatggtcaccgtctcctcc

SEQ ID NO: 17291 - RNA, 432 nt, synthetic construct
  misc_feature 1..432: note = derived and/or modified sequence opt2 from anti-HIV_cap256-059-155838_VR-Chain
  source 1..432: mol_type = other RNA
caggtccagctcgtcgagtccggcggcggcgtcgtccagcccggccgctccctccgcctctcctgcgccgtctcccagttcaccttctccaactacggcatgcactgggtccgccaggcccccggcaagggcctcgagtgggtcgccgccatctccttcgccggcaccaagaagtcctacgccgcctccgtcaagggccgcttcaccatctcccgcgacaactccaagaacaccctctacctccagatgaactccctccgccccgaggacaccgccctctactactgcgccaaggacatgcgcggcttcgagtgcgaggagtgggcctccgactactacgacttcggccgcgagcagccctgccaggacccccgcggcgtcgtcggcatcttcgacctctggggccagggcaccatggtctccgtctcctcc

SEQ ID NO: 17292 - RNA, 432 nt, synthetic construct
  misc_feature 1..432: note = derived and/or modified sequence opt2 from anti-HIV_cap256-059-149799_VR-Chain
  source 1..432: mol_type = other RNA
caggtccacctcgtcgagtccggcggcggcgtcgtccagcccggccgctccctccgcctctcctgcgccgcctcccagttcaccttctccaactacggcttccactgggtccgccaggcccccggcaagggcctcgagtgggtcgccgccatctccttcgccggcgtcaagaagcactacgccgactccgtcaagggccgcttcaccatctcccgcgacaactccaagaacaccctctacctccagctcaactccctccgcgccgaggacaccgccctctactactgcgccaaggacctccgcgagtacgagtgcgaggagtgggcctccgactactacgacttcggccgcgacttcccctgccaggacccccgcggcgtcgtcggcaccttcgacatctggggccagggcaccatggtcaccgtctcctcc

SEQ ID NO: 17293 - RNA, 432 nt, synthetic construct
  misc_feature 1..432: note = derived and/or modified sequence opt2 from anti-HIV_cap256-059-148168_VR-Chain
  source 1..432: mol_type = other RNA
caggtccagctcgtcgagtccggcggcggcgtcgtccagcccggccgctccctccgcctctcctgcaccgcctcccagttcaccttctccaactacggcatgcactgggtccgccaggcccccggcaagggcctcgagtgggtcgccggcatctccttcgccgccaccaagaagtactactccgactccgtcaagggccgcttcaccatctcccgcgacaactccaagaacgccctctacctccagatgaactccctccgcgccgaggacaccgccctctaccactgcgccaaggacctccgcgagtacgagtgcgaggagtgggcctccgactactacgacttcggccgcgagcagccctgccaggacccccgcggcgtcgtcggcaccttcgacatctggggccagggcaccatggtcaccgtctccacc

SEQ ID NO: 17294 - RNA, 435 nt, synthetic construct
  misc_feature 1..435: note = derived and/or modified sequence opt2 from anti-HIV_cap256-059-144685_VR-Chain
  source 1..435: mol_type = other RNA
caggtccacctcgtcgagtccggcggcggcgtcgtccagcccggccgctccctccgcctctcctgcgccgcctccggcttcaccttctccaacttcgccatggactgggtccgccaggcccccggcaagggcctcgagtgggtcgccttcgtctcctccgacggcaacaacaagaactacggcgactccgtcaagggccgcttcaccatctcccgcgacaactccaagaacaccctcttcctccagatgaactccctccgcgccgaggacaccgccctctactactgcgtcaaggacgtcggcgactacaagtccgacgagtgggccacccactactactacgacctctccatcgccgaccccatccaggacccccgcgccgtcgtcggcgccttcgacatctggggccgcggcaccatggtcgccgtctcctcc

SEQ ID NO: 17295 - RNA, 432 nt, synthetic construct
  misc_feature 1..432: note = derived and/or modified sequence opt2 from anti-HIV_cap256-059-140017_VR-Chain
  source 1..432: mol_type = other RNA
caggtccagctcgtcgagtccggcggcggcgtcgtccagcccggccgctccctccgcctctcctgcgccgcctcccagttctccttcggcaacttcggcatgcactgggtccgccaggcccccggcaagggcctcgagtgggtcgccggcatctccttcgccggcaccaagaagtactacgccgactccgtcaagggccgcttcaccatctcccgcgacaactccaagtccgccctcttcctccagatgaactccctccgcgccgaggacaccgccctctactactgcgccaaggacctccgctactacgagtgcgaggagtgggcctccgactactacgacttcggccgcgaccagccctgccaggacccccgcggcgtcgtcggcaccttcgacatgtggggccagggcaccatggtcaccgtctcctcc

SEQ ID NO: 17296 - RNA, 432 nt, synthetic construct
  misc_feature 1..432: note = derived and/or modified sequence opt2 from anti-HIV_cap256-059-137547_VR-Chain
  source 1..432: mol_type = other RNA
caggtccagctcgtcgagtccggcggcggcgtcgtccagcccggccgctccctccgcctctcctgcgccgcctcccagttcaccttctcccgctacggcatgcactgggtccgccaggcccccggcaagggcctcgagtgggtcgccgccatctccttcgccggcatcaagaagaactacgccgactccgtcaagggccgcttcaccatctcccgcgacaactccaagaacaccctctacctccagatgaactccctccgcgccgaggacaccgccctctactactgcgcccgcgacctccgcgagttcgagtgcgaggagtgggcctccgactactacgacttcggccgcgacttcccctgccaggacccccgcggcgtcgtcggcatcttcgacatctggggccagggcaccatggtcaccgtctcctcc

SEQ ID NO: 17297 - RNA, 435 nt, synthetic construct
  misc_feature 1..435: note = derived and/or modified sequence opt2 from anti-HIV_cap256-059-131908_VR-Chain
  source 1..435: mol_type = other RNA
caggtccagctcgtcgagtccggcggcggcgtcgtccagcccggccgctccctccgcctctcctgcaccgcctccggcttcaccttctccaactacggcatccactgggtccgccaggcccccggcaagggcctcgagtgggtcgccgccatctcctacgagggctccatcaagtactacgtcgactccgtcaagggccgcttcaccatctcccgcgacgactccaagaacaccctcttcctccagatgaactccctccgcaccgaggacaccgccgtctactactgcacccgcgacgtccgcgagtgggagaccgaggagtgggccaccaactactactacgacctctccatcgcctaccccatccgccacccccgcggcgtcgtcggcatcttcgacgtctggggcctcggcacccgcgtcaccgtctcctcc

SEQ ID NO: 17298 - RNA, 432 nt, synthetic construct
  misc_feature 1..432: note = derived and/or modified sequence opt2 from anti-HIV_cap256-059-116006_VR-Chain
  source 1..432: mol_type = other RNA
caggcccagctcgtcgagtccggcggcggcgtcgtccagcccggccgctccctccgcctctcctgcgccgcctcccagttctccttctcctcctacggcatgcactgggtccgccaggcccccggcaagggcctcgagtgggtcgcctccatctccttcgccggcgtcaagaagaccaacgccgactccgtcaagggccgcttcaccatctcccgcgacaactccaagaacaccctccacctccagatgaacggcctccgcaacgacgacaccgccctctactactgcgcccgcgacctccgcgacttcgagtgcgaggagtgggcctccgactactacgacttcggccgcgagttcccctgccaggacccccgcggcgtcgtcggcaccttcgacatctggggccagggcaccaaggtcaccgtctcctcc

SEQ ID NO: 17299 - RNA, 411 nt, synthetic construct
  misc_feature 1..411: note = derived and/or modified sequence opt2 from anti-HIV_cap256-059-115783_VR-Chain
  source 1..411: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctcctacgccgactccgtcaagggccgcttcaccatctcccgcgacaactccaagaacaccctctacctccagatgaactccctccgcgccgaggacaccgccctctactactgcgccaaggacctccgcgagatggagtgcgaggagtgggcctccgactactacgacttcggccgcgacctcccctgccaggacccccgcggcgtcgtcggcaccctcgacatctggggccagggcaccatggtcaccgtctcctcc

SEQ ID NO: 17300 - RNA, 432 nt, synthetic construct
  misc_feature 1..432: note = derived and/or modified sequence opt2 from anti-HIV_cap256-059-114609_VR-Chain
  source 1..432: mol_type = other RNA
caggtccagctcgtcgagtccggcggcggcgtcgtccagcccggccgctccctccgcctctcctgcgccgcctcccagctcaccttctccaacttcggcatgcactgggtccgccaggcccccggcaagggcctcgagtgggtcgccggcatctccttcgccggcaccaagaagtactacgccgactccgtcaagggccgcttcaccatctcccgcgacaactccaagaacgccctctacctccagatgaacaccctccgcgccgaggacaccgccctctacttctgcgccaaggacctccgcgagtacgagtgcgaggagtgggcctccgactactacgacttcggccgcgaccagccctgccaggacccccgcggcgtcgtcggcatcttcgacatctggggccagggcaccatggtcaccgtctcctcc

SEQ ID NO: 17301 - RNA, 432 nt, synthetic construct
  misc_feature 1..432: note = derived and/or modified sequence opt2 from anti-HIV_cap256-059-113952_VR-Chain
  source 1..432: mol_type = other RNA
caggcccagctcgtcgagtccggcggcggcgtcgtccagcccggccgctccctccgcctctcctgcgccgcctcccacttcaccttctcctcctacggcttccactgggtccgccaggcccccggcaagggcctcgagtgggtcgccggcatctccttcgccgccaccaagaagtactacgccgactccgtcaagggccgcttcaccatctcccgcgacaactccaaggacgccctctacctccagatgaactccctccgcgccgaggacaccgccctctactactgcgcccgcgacctccgcggctacgagtgcgaggagtgggcctccgactactacgacttcggccgcgaccagccctgccaggacccccgcggcgtcgtcggcatcttcgacctctggggccagggcaccatggtcaccgtctcctcc

SEQ ID NO: 17302 - RNA, 432 nt, synthetic construct
  misc_feature 1..432: note = derived and/or modified sequence opt2 from anti-HIV_cap256-059-113878_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccctcatctcctacgacgccaccaacaagtactacgtcgactccgtcaagggccgcttcaccatctcccgcgacaactccaagaacaccctctacctccagatgtcctccctcaccgccgaggacaccgccgtctactactgcgccaaggacctcggcggcatcaagatcgacgagtggggcaccgactactacgacatctccgtctcctaccccgtccaggacccccgcgccgtcgccggcatcttcgacgtctggggccacggcaccatggtctccgtctcctcc

SEQ ID NO: 17303 - RNA, 432 nt, synthetic construct
  misc_feature 1..432: note = derived and/or modified sequence opt2 from anti-HIV_cap256-059-113622_VR-Chain
  source 1..432: mol_type = other RNA
caggtccagctcgtcgagtccggcggcggcgtcgtccagcccggccgctccctccgcctctcctgcgccgcctcccagttcaccttcacctcctacggcatgcactgggtccgccaggcccccggcaagggcctcgagtgggtcgccggcatctccttcgccggcaccaagaagcactacgccgactccgtcaagggccgcttcaccatctcccgcgacaactccaagtccaccctctacctccagatgaactccctccgcgccgaggacaccgccctctactactgcgccaaggacatgcgcgagtacgagtgcgaggagtgggcctccgactactacgacttcggccgcgaccagccctgccaggacccccgcggcgtcgtcggcatcttcgacctctggggccagggcaccatggtcaccgtctcctcc

SEQ ID NO: 17304 - RNA, 432 nt, synthetic construct
  misc_feature 1..432: note = derived and/or modified sequence opt2 from anti-HIV_cap256-059-109427_VR-Chain
  source 1..432: mol_type = other RNA
caggtccagctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgcctccatctccttcgccggcatcaagaagcactacaccgactccgtcaagggccgcttcaccatctcccgcgacaactccaagaacaccctcttcctccagatgaactccctccgcgccgaggacaccgccctctactactgcgcccgcgacctccgcgagtacgagtgcgaggagtgggcctccgactactacgacttcggccgcgaccagccctgccaggacccccgcggcgtcgtcggcacctccgacatctggggccagggcaccaaggtcaccgtctcctcc

SEQ ID NO: 17305 - RNA, 432 nt, synthetic construct
  misc_feature 1..432: note = derived and/or modified sequence opt2 from anti-HIV_cap256-059-109081_VR-Chain
  source 1..432: mol_type = other RNA
caggagcagctcgtcgagtccggcggcggcgtcgtccagcccggccgctccctccgcctctcctgcgccgcctcccagttctccttctccgcctacggcatgcactgggtccgccaggcccccggcaagggcctcgagtgggtcgccggcatctccttcgccgccaccaagaagtactacgaggactccgtcaagggccgcttcaccatctcccgcgacaactccaagaacaccctctacctccagatgaactccctccgcggcgaggacaccgccctctactactgcgccaaggacatgcgcgagatggagtgcgaggagtgggcctccgactactacgacttcggccgcccccagccctgccaggacccccgcggcgtcgtcggcatcttcgacatgtggggccagggcaccatggtcaccgtctcctcc

SEQ ID NO: 17306 - RNA, 432 nt, synthetic construct
  misc_feature 1..432: note = derived and/or modified sequence opt2 from anti-HIV_cap256-059-107590_VR-Chain
  source 1..432: mol_type = other RNA
caggagcagctcgtcgagtccggcggcggcgtcgtccagcccggccgctccctccgcctctcctgcgccgcctcccagttctccatctccgcctacggcatgcactgggtccgccaggcccccggcaagggcctcgagtgggtcgccggcatctccttcgccggcaccaagaagtactacgccgactccgtcaagggccgcttcaccatctcccgcgacaactccaagaacaccctctacctccagatgaactccctccgcggcgaggacaccgccctctactactgcgccaaggacatgcgcgagatggagtgcgaggagtgggcctccgactactacgacttcggccgcgaccagccctgccaggacccccgcggcgtcgtcggcatcttcgacatgtggggccagggcaccatggtcaccgtctcctcc

SEQ ID NO: 17307 - RNA, 435 nt, synthetic construct
  misc_feature 1..435: note = derived and/or modified sequence opt2 from anti-HIV_cap256-059-107504_VR-Chain
  source 1..435: mol_type = other RNA
caggtcctcctcgtcgagtccggcggcggcgtcgtccagcccggcaagtccctccgcctctcctgctccgcctcccgcttcaccttctccaactacggcatgcactgggtccgccaggcccccggcaagggcctcgagtgggtcgccgccgtctccttcgccggcatcaagaagaccaacgccgactccgtcaagggccgcttcaccatctcccgcgacaactccaagaacaccctctacctccagatgaactccctccgcgccgaggacaccgccctctactactgcgcccgcgacctccgcgacttcgagtgcgaggagtgggcctccgactactacgacttctggggcgacccccagccctgccaggacccccgcggcgtcgtcggcaccttcgacctctggggccagggcaccatggtcaccgtctcctcc

SEQ ID NO: 17308 - RNA, 432 nt, synthetic construct
  misc_feature 1..432: note = derived and/or modified sequence opt2 from anti-HIV_cap256-059-099614_VR-Chain
  source 1..432: mol_type = other RNA
gaggtcctcctcctcgagtccggcggcggcctcgtccagcccggccgctccctccgcctctcctgcgccgcctcccagttcaccttctcctcctacggcatgcactgggtccgccaggcccccggcaagggcctcgagtgggtcgccggcatctccttcgtcggcatcaagaagtactacgccgactccgtcaagggccgcttcaccatctcccgcgacaactccaagaacaccctctacctccagatgaactccctccgcgccgaggacaccgccctctactactgcgcccgcgacctccgcgagtacgagtgcgaggagtgggcctccgactactacgacttcggccgcgaccagccctgccaggacccccgcggcgtcgtcggcaccttcgacatctggggccagggcaccatggtcaccgtctcctcc

SEQ ID NO: 17309 - RNA, 432 nt, synthetic construct
  misc_feature 1..432: note = derived and/or modified sequence opt2 from anti-HIV_cap256-059-098972_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgcctccatctccttcgccggcatcaagaagaactaccgcgactccgtcaagggccgcttcaccatctcccgcgacaactccaagaacaccctctacctccagatgacctccctccgccccgaggacaccgccctctactactgcgccaaggacctccgcggcttcgagtgcgaggagtgggcctccgactactacgacttcggccgcgagctcccctgccaggacccccgcggcgtcgtcggcaccttcgacatgtggggccagggcaccatggtcaccgtctcctcc

SEQ ID NO: 17310 - RNA, 432 nt, synthetic construct
  misc_feature 1..432: note = derived and/or modified sequence opt2 from anti-HIV_cap256-059-097236_VR-Chain
  source 1..432: mol_type = other RNA
caggtccagctcgtcgagtccggcggcggcgtcgtccagcccggccgctccctccgcctctcctgcgccgcctccggcttctccttctccaacttcggcttccactgggtccgccaggcccccggcaagggcctcgagtgggtcgccgccatctccttcgtcggcaacaagaagtactacgccgagtccgtcaagggccgcttcaccatctcccgcgagaactccaagaacatgctcttcctccagatgaactccctccgcggcgaggacaccgccgtctactactgcgccaaggacctccgcgagttcgagtgcgaggagtgggcctccgactactacgacttcggccgcgagcagccctgccaggacccccgcggcgtcgtcggctccatcgacgtctggggccacggctccctcgtcaccgtctcctcc

SEQ ID NO: 17311 - RNA, 432 nt, synthetic construct
  misc_feature 1..432: note = derived and/or modified sequence opt2 from anti-HIV_cap256-059-091487_VR-Chain
  source 1..432: mol_type = other RNA
caggtccagctcgtcgagtccggcggcggcgtcgtccagcccggccgctccctccgcctctcctgcgccgcctcccagttcaccttcaaccgctacggcatgcactgggtccgccaggcccccggcaagggcctcgagtgggtcgccgtcatctcctacgacggcaccaacaagtactacggcgagtccgtcaagggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggccgcgagctcccctgccgcaagtcccgcggcgtcgccggcatcttcgacatctggggccagggcaccatggtcaccgtctcctcc

SEQ ID NO: 17312 - RNA, 432 nt, synthetic construct
  misc_feature 1..432: note = derived and/or modified sequence opt2 from anti-HIV_cap256-059-089812_VR-Chain
  source 1..432: mol_type = other RNA
caggtccagctcgtcgagtccggcggcggcgtcgtccagcccggccgctccctccgcctctcctgcgccgcctcccagctcaccttctcctcctacggcatgcactgggtccgccaggcccccggcaagggcctcgagtgggtcgccggcatctccttcgccggcaccaagaagcactactccgactccgtcaagggccgcttcaccatctcccgcgacaactccaagaacgccctctacctccagatgaactccctccgcgccgaggacaccgccctctactactgcgccaaggacctccgcgagtacgagtgcgaggagtgggcctccgactactacgacttcggccgcgagcagccctgccaggacccccgcggcgtcgtcggcatcttcgacatgtggggccagggcaccatggtcaccgtctcctcc

SEQ ID NO: 17313 - RNA, 432 nt, synthetic construct
  misc_feature 1..432: note = derived and/or modified sequence opt2 from anti-HIV_cap256-059-088468_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgtcggcatcaagaagtactacgccaactccgtcaagggccgcttcaccatctcccgcgacaactccaagaacaccctctacctccagatgaactccctccgcgccgaggacaccgccctctactactgcgcccgcgacctccgcgagtacgagtgcgaggagtgggcctccgactactacgacttcggccgcggcggcccctgccaggacccccgcggcgtcgtcggctccttcgacatctggggccagggcaccatggtcaccgtctcctcc

SEQ ID NO: 17314 - RNA, 432 nt, synthetic construct
  misc_feature 1..432: note = derived and/or modified sequence opt2 from anti-HIV_cap256-059-088341_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgccggcatcaagaagcactacgccgactccgtcaagggccgcttcaccatctcccgcgacaactccaagaacatggtcttcctccagatgaactccctccgcgccgaggacaccgccctctactactgcgcccgcgacctccgcgagtacgagtgcgaggagtgggcctccgactactacgacttcggccgcgaccagccctgccaggacccccgcggcgtcgtcggcacctccgacatctggggccagggcaccatggtcaccgtctcctcc

SEQ ID NO: 17315 - RNA, 432 nt, synthetic construct
  misc_feature 1..432: note = derived and/or modified sequence opt2 from anti-HIV_cap256-059-086533_VR-Chain
  source 1..432: mol_type = other RNA
caggtcctcctcgtcgagtccggcggcggcgtcgtccagcccggccgctccctccgcctctcctgcgccgcctcccagttcaccttctccaacttcggcatgcactgggtccgccaggcccccggcaagggcctcgagtgggtcgccggcatctccttcgtcggcatcaagaagtactacgccggctccgtcaagggccgcttcaccatctcccgcgacaactccaagaacaccctctacctccagatgaactccctccgcgccgaggacaccgccctctactactgcgccaaggacctccgcgagttcgagtgcgaggagtgggcctccgactactacgacttcggccgcccccagccctgccaggacccccgcggcgtcgtcggcaccttcgacctctggggcctcggcaccctcgtcaccgtctcctcc

SEQ ID NO: 17316 - RNA, 432 nt, synthetic construct
  misc_feature 1..432: note = derived and/or modified sequence opt2 from anti-HIV_cap256-059-086043_VR-Chain
  source 1..432: mol_type = other RNA
gaggtccacctcgtcgagtccggcggcggcctcgtcaagcccggcggctccctccgcctctcctgcgccgcctccggcttcaccttctccacctactccatgaactgggtccgccaggcccccggcaagggcctcgagtgggtcgccttcgtcgccttcgacgagtccgacaagtactacgccgactccgtcaagggccgcttcaccatctcccgcgacaactccaagaacaccctctccctccagatgaactccctccgcgtcgaggacaccgccatctactactgcgccaaggaggtcggcgacaacaaggacgacgagtgggcctccgactactacgacctctccatcgcctaccccatccaggacccccgcgccgtcggccgcggctacgacatctggggccagggcaccatggtcaccgtctcctcc

SEQ ID NO: 17317 - RNA, 432 nt, synthetic construct
  misc_feature 1..432: note = derived and/or modified sequence opt2 from anti-HIV_cap256-059-084191_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgtcggcatcaagaagtactacgccgactccgtcaagggccgcttcaccgtctcccgcgacaactccaagtccaccctctacctccagatgaactccctccgcgccgaggacaccgccctctactactgcgcccgcgacctccgcgagtacgagtgcgaggagtgggcctccgactactacgacttcggccgcgaccagccctgccaggacccccgcggcgtcgtcggcatcttcgacatctggggccagggcaccgccgtcaccgtctcctcc

SEQ ID NO: 17318 - RNA, 417 nt, synthetic construct
  misc_feature 1..417: note = derived and/or modified sequence opt2 from anti-HIV_cap256-059-082135_VR-Chain
  source 1..417: mol_type = other RNA
caggtccagctcgtcgagtccggcggcggcgtcgtccagcccggccgctccctccgcctctcctgcaccgcctccggcttcaccttccgctcctacgccatccactgggtccgccaggcccccggcaagggcctcgagtgggtcgccctcatctcctacgacggctccaacaagtactacgccgactccgtcaagggccgcttcaccatctcccgcgacaactccaagaacaccctctacctccagatgaactccctcacctccgaggacaccgccgtctactactgcgccaaggacctcggcggctccaagaccgacgagtggggcaccgactactgctaccccgtccaggacccccgcgtcgtcgtcggcgccttcgacatctggggccacggcaccatggtcaccgtctcctcc

SEQ ID NO: 17319 - RNA, 432 nt, synthetic construct
  misc_feature 1..432: note = derived and/or modified sequence opt2 from anti-HIV_cap256-059-079417_VR-Chain
  source 1..432: mol_type = other RNA
caggtccagctcgtcgagtccggcggcggcgtcgtccagcccggccgctccctccgcctctcctgcgccgcctccggcttctccttctccaactacgccatggactgggtccgccaggcccccggcaagggcctcgagtgggtcgccttcgtctcctccgacggcaacaacaagaagtacgccgactccgtcaagggccgcttcaccctctcccgcgacaactacaagaacaccgtctacctccagatgaactccctcaccgtcgaggacaccgccgtctactactgcgccaaggacctcggcgccaacaaggacgacgagtggggcaccgactactacgacatgtccgtctcctaccccatccccgacccccgcgccgtcgtcggcgccttcgacgtctggggccagggcaccctcgtcaccgtctcctcc

SEQ ID NO: 17320 - RNA, 435 nt, synthetic construct
  misc_feature 1..435: note = derived and/or modified sequence opt2 from anti-HIV_cap256-059-076027_VR-Chain
  source 1..435: mol_type = other RNA
caggtccagctcgtcgagtccggcggcggcgtcgtccagcccggccgctccctccgcctctcctgcgccgcctccggcttctccttctccaagtacggcatgcactgggtccgccaggcccccggcaagggcctcgagtgggtcgccttcgtcgccttcgacgagtccgagaagtactacgccgcctccgtcaagggccgcttcaccatctcccgcgacaactccaagaacaccctctccctccagatgaactccctccgcaccgaggacaccgccatctactactgcgccaaggaggtcggcgacaacaaggacgacgagtggacctccccctactactacgacatctccatcgcctaccccgtccacgacccccgcgccgtcgtcggcgtctccgacgtctggggccagggcaccatggtcaccgtctcctcc

SEQ ID NO: 17321 - RNA, 432 nt, synthetic construct
  misc_feature 1..432: note = derived and/or modified sequence opt2 from anti-HIV_cap256-059-075082_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgtcggcatcaagaagtactacgccgactccgtcaagggccgcttcaccatctcccgcgacaactccaagaacaccctctacctccagatgaactccctccgcgccgaggacaccgccctctactactgcgccaaggacctccgcgagatggagtgcgaggagtgggcctccgactactacgacttcggccgcgacctcccctgccaggacccccgcggcgtcgtcggcaccctcgacatctggggccagggcaccatggtcaccgtctcctcc

SEQ ID NO: 17322 - RNA, 432 nt, synthetic construct
  misc_feature 1..432: note = derived and/or modified sequence opt2 from anti-HIV_cap256-059-072575_VR-Chain
  source 1..432: mol_type = other RNA
cagggccagctcgtcgagtccggcggcggcgtcgtccagcccggccgctccctccgcctctcctgcgccgcctcccagttcaccttctccaacttcggcatgcactgggtccgccaggcccccggcaagggcctcgagtgggtcgccgtcatctcctacgacggcaccaagaagtactacgccgactccgtcaagggccgcttcaccatctcccgcgacaactccaagaacaccctctacctccagatgaactccctccgcgccgaggacaccgccctctactactgcgccaaggacatgcgcgaggacgagtgcgaggagtggggcgccgactactacgacttcggcaaggactacccctgccaggcctcccgcggcgtcgtcggcatcttcgacatctggggccagggcaccatggtcaccgtctccgcc

SEQ ID NO: 17323 - RNA, 432 nt, synthetic construct
  misc_feature 1..432: note = derived and/or modified sequence opt2 from anti-HIV_cap256-059-071926_VR-Chain
  source 1..432: mol_type = other RNA
caggtccagctcgtcgagtccggcggcggcgtcgtccagcccggccgctccctccgcctctcctgcgccgcctcccagctctccttctccaactacggcatgcactgggtccgccaggcccccggcaagggcctcgagtgggtcgccggcatctccttcgtcggcatcaagaagtactaccgcgactccgtcaagggccgcttcaccatctcccgcgacaactccaagaacaccctctacctccagatgaactccctccgcaccgaggacaccgccctctactactgcgtcaaggacctccgcgagttcgagtgcgaggagtgggcctccgactactacgacttcggccgcgaccagccctgcctcgacccccgcggcgtcgtcggcaccttcgacatctggggccagggcaccatggtcaccgtctcctcc

SEQ ID NO: 17324 - RNA, 432 nt, synthetic construct
  misc_feature 1..432: note = derived and/or modified sequence opt2 from anti-HIV_cap256-059-069638_VR-Chain
  source 1..432: mol_type = other RNA
caggtccagctcgtcgagtccggcggcggcgtcgtccagcccggccgctccctccgcctctcctgcgccgcctccggcttcaccttctccaagaacgccatgcactgggtccgccaggcccccggccgcggcctcgagtgggtcgcctccgtcgccttcgacggctccgacaagtactacgccgactccgtcaagggccgcttcaccatctcccgcgacaactccaagaacaccctctccctccagatgaactccctccgcgccgaggacaccgccgtctactactgcgccaaggaggtcgacctctacaaggacgacgagtggggctccgactactacgacctctccatcgcctaccccatccaggacccccgcgccgtcgtcggcggcttcggcatctggggccagggcaccatggtcaccgtctcctcc

SEQ ID NO: 17325 - RNA, 432 nt, synthetic construct
  misc_feature 1..432: note = derived and/or modified sequence opt2 from anti-HIV_cap256-059-069165_VR-Chain
  source 1..432: mol_type = other RNA
ctcgtccagctcgtcgagtccggcggcggcgtcgtccagcccggccgctccctccgcctctcctgcgccgcctcccgcttcaccttctccaactacggcatgcactgggtccgccaggcccccggcaagggcctcgagtgggtcgccggcatctccttcgccggcaccaccaagtactacgccgactccgtccgcggccgcttcaccatctcccgcgacaactccaagaacaccctctacctccagatgaactccctccgcgccgaggacaccgccctctactactgcgccaaggacatgcgcgagatggagtgcgaggagtgggcctccgactactacgacttcggccgcccccagccctgccaggacccccgcggcgtcgtcggcatcttcgacatctggggccagggcaccatggtcaccgtctcctcc

SEQ ID NO: 17326 - RNA, 432 nt, synthetic construct
  misc_feature 1..432: note = derived and/or modified sequence opt2 from anti-HIV_cap256-059-068956_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggccgcggcctcgagtgggtcgccctcatctcctacgacggctccaacaagtactacgtcgactccgtcaagggccgcttcaccatctcccgcgacaactccaagaacaccctctacctccagatgaactccctcaccgccgaggacaccgccgtctactactgcgccaaggacctcggcggctccaaggacgacgagtgggccaccgactactacgacctctccatcgcctaccccatccaggacccccgcgccgtcgccggcatcttcgacgtctggggccgcggcaccgtcgtcaccgtctcctcc

SEQ ID NO: 17327 - RNA, 432 nt, synthetic construct
  misc_feature 1..432: note = derived and/or modified sequence opt2 from anti-HIV_cap256-059-068876_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgccggcaccaagaagtactacgccaactccgtcaagggccgcttcaccatctcccgcgacaactccaagaacaccctctccctccagatgaactccctccgcggcgaggacaccgcccgctactactgcgcccgcgacccccgcgagtacgagtgcgaggagtgggcctccgactactacgacttcggccgcgaccagccctgccaggacccccgcggcgtcatcggcatcttcgacatctggggccagggcaccatggtcaccgtctcctcc

SEQ ID NO: 17328 - RNA, 432 nt, synthetic construct
  misc_feature 1..432: note = derived and/or modified sequence opt2 from anti-HIV_cap256-059-067733_VR-Chain
  source 1..432: mol_type = other RNA
caggtccagctcgtcgagtccggcggcggcgtcgtccagcccggccgctccctccgcctctcctgcaccgcctcccagttctccttctcctcctacggcatgcactgggtccgccaggcccccggcaagggcctcgagtgggtcgccgccatctccttcgccggcaccaagaagaactacgtcgactccgtcaagggccgcttcaccatctcccgcgacaactccaagaacaccctctacctccagatgaactccctccgcgccgacgacaccgccctctactactgcgccaaggacatgcgcgagtacgagtgcgaggagtgggcctccgactactacgacttcggccgcgagtacccctgcaccgacccccgcggcgtcgtcggcaccttcgacgtctggggccagggcaccatggtcaccgtctcctcc

SEQ ID NO: 17329 - RNA, 432 nt, synthetic construct
  misc_feature 1..432: note = derived and/or modified sequence opt2 from anti-HIV_cap256-059-067450_VR-Chain
  source 1..432: mol_type = other RNA
caggtccagctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgccggcatctccttcgccggcatcaagaagtactacgccgactccgtcaagggccgcttcaccatctcccgcgacaacgccaagaacaccctctacctccagatgaactccctccgcgccgaggacaccgccctctactactgcgccaaggacctccgcgagtacgagtgcgaggagtgggcctccgactactacgacttcggccgcgagctcccctgccaggacccccgcggcgtcgtcggcaccttcgacatctggggccagggcaccatggtcaccgtctcctcc

SEQ ID NO: 17330 - RNA, 432 nt, synthetic construct
  misc_feature 1..432: note = derived and/or modified sequence opt2 from anti-HIV_cap256-059-065694_VR-Chain
  source 1..432: mol_type = other RNA
caggtccagctcgtcgagtccggcggcggcgtcgtccagcccggccgctccctccgcctctcctgcgccgcctcccagctcaccttcaacaactacggcatgcactgggtccgccagacccccggcaagggcctcgagtgggtcgccggcatctccttcgccggcatcaacaagtactacgccgactccgtcaagggccgcttcaccatctcccgcgacaactccaagaacgccctctacctccagatgacctccctccgcgccgaggacaccgccctctactactgcgtcaaggacctccgcgagatggagtgcgaggagtgggcctccgactactacgacttcggccgcgaccagccctgccaggacccccgcggcgtcgtcggcaccttcgacatctggggccagggcaccatggtcaccgtctcctcc

SEQ ID NO: 17331 - RNA, 432 nt, synthetic construct
  misc_feature 1..432: note = derived and/or modified sequence opt2 from anti-HIV_cap256-059-065109_VR-Chain
  source 1..432: mol_type = other RNA
caggtccagctcgtcgagtccggcggcggcgtcgtccagcccggcaagtccctccgcctctcctgcgccgcctccggcttcaccttcaccaacaacgccatgaactgggtccgccaggcccccggcaagggcctcgagtgggtcgccttcgtctcctccgacggccgcaacaagaactacgccgactccgtcaagggccgcttcaccatctcccgcgacaactccaagaacaccgtctacctccagatgaactccctccgcgtcgaggacaccgccctctactactgcgccaaggacctcggcgccaacaaggacgacgagtgggccaccgactactacgacctctccgtcgcctaccccatccccgacccccgcgccgtcgtcggcgccttcgacgtctggggccagggcaccatggtcaccgtctcctcc

SEQ ID NO: 17332 - RNA, 432 nt, synthetic construct
  misc_feature 1..432: note = derived and/or modified sequence opt2 from anti-HIV_cap256-059-065060_VR-Chain
  source 1..432: mol_type = other RNA
caggtccagctcgtcgagtccggcggcggcgtcgtccagcccggcacctccctccgcctctcctgcgccgcctccggcttcaccttctccaactacgccatgggctgggtccgccaggcccccggcaagggcctcgagtgggtcgccgtcgtctcctacgacggctccaagaagtcctacgccgactccgtcaagggccgcttcaccatctcccgcgacaactcccgcaacaccctctacctccagctcaactccctccgcgccgaggacaccgccatgttctactgcgccaaggacctcggcaagggcgagatcgaggagtgggccaccgactactacgactggtccaaggcctaccccatcgagggcccccgcgacgtcgtcggcgccttcgacacctggggccagggcaccctcgtcaccgtctcctcc

SEQ ID NO: 17333 - RNA, 432 nt, synthetic construct
  misc_feature 1..432: note = derived and/or modified sequence opt2 from anti-HIV_cap256-059-064001_VR-Chain
  source 1..432: mol_type = other RNA
caggtccagctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgccggcatctccttcgccggcaccaagaactactacgccaagtccgtcaagggccgcttcaccatctcccgcgacaactccaagaacgccctctacctccagatgaactccctccgcgccgaggacaccgccctctactactgcgccaaggacatgcgcgagtacgagtgcgaggagtgggcctccgactactacgacttcggccgcgaccagccctgccaggacccccgcggcgtcgtcggcaccttcgacatctggggccagggcaccatggtcgccgtctcctcc

SEQ ID NO: 17334 - RNA, 432 nt, synthetic construct
  misc_feature 1..432: note = derived and/or modified sequence opt2 from anti-HIV_cap256-059-063270_VR-Chain
  source 1..432: mol_type = other RNA
caggtccagctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgccgccatctccttcgccggcaccaagaagcactacgccgactccgtcaagggccgcttcaccatctcccgcgacaactccaagaacgccctctacctccagatgaactccctccgcgccgaggacaccgccctctactactgcgccaaggacctccgcgagtacgagtgcgaggagtgggcctccgactactacgacttcggccgcgaccagccctgcctcgacccccgcggcgtcgtcggcatcttcgacatctggggccagggcaccctcgtcaccgtctcctcc

SEQ ID NO: 17335 - RNA, 432 nt, synthetic construct
  misc_feature 1..432: note = derived and/or modified sequence opt2 from anti-HIV_cap256-059-061357_VR-Chain
  source 1..432: mol_type = other RNA
caggtccagctcgtcgagtccggcggcggcgtcgtccagcccggccgctccctccgcctctcctgcgccgcctccggcttcaccttctccaacttcggcttccactgggtccgccaggcccccggcaagggcctcgagtgggtcgccggcatctccttcgccggcaccaagatctactacgccgactccgtcaagggccgcttcaccatctcccgcgagaactccaagaacatgctctacctccagatgaactccctccgcggcgaggacaccgccgtctacttctgcgccaaggacctccgcgagttcgagtgcgaggagtgggcctccgactactacgacttcggccgcgagttcccctgccaggacccccgcggcgtcgtcggcaccttcgacgtctggggccacggcgccgtcgtcaccgtctcctcc

SEQ ID NO: 17336 - RNA, 435 nt, synthetic construct
  misc_feature 1..435: note = derived and/or modified sequence opt2 from anti-HIV_cap256-059-059834_VR-Chain
  source 1..435: mol_type = other RNA
caggtccagctcgtcgagtccggcggcggcgtcgtccagcccggccgctccctccgcctctcctgcgccgcctccggcttcaccttctccaacttcggcatgcactgggtccgccaggcccccggcaagggcctcgagtgggtcgccttcgtcgccttcgacgagtccgacaagtactacgccgcctccgtcaagggccgcttcaccgtctcccgcgacaactccaagaacaccgtctccctccagatgaactccctccgcaccgaggacaccgccgtctactactgcgccaaggaggtcggcgacaacaaggacgacgagtggacctccccctactactacgacttctccatcgcctaccccgtccacgacccccgcgccgtcgtcggcggctacgacgtctggggccagggcaccatggtcaccgtctcctcc

SEQ ID NO: 17337 - RNA, 432 nt, synthetic construct
  misc_feature 1..432: note = derived and/or modified sequence opt2 from anti-HIV_cap256-059-059313_VR-Chain
  source 1..432: mol_type = other RNA
caggtccacctcgtcgagtccggcggcggcgtcgtccagcccggcaagtccctccgcctctcctgcgccgcctcccagttcaccttctccaacttcggcatgcactgggtccgccaggcccccggcaagggcctcgagtgggtcgccggcatctccttcgccggcaccaagaagtactacgccgactccgtcaagggccgcttcaccatctcccgcgacaactccaagaacaccctctacctccagatgaactccgtccgcgccgaggacaccgccctctactactgcgccaaggacatgcgcgagtacgagtgcgaggagtgggcctccgactactacgacttcggcaagccccagccctgccaggacccccgcggcgtcgtcggcaccttcgacatgtggggcctcggcaccctcgtcaccgtctcctcc

SEQ ID NO: 17338 - RNA, 432 nt, synthetic construct
  misc_feature 1..432: note = derived and/or modified sequence opt2 from anti-HIV_cap256-059-057130_VR-Chain
  source 1..432: mol_type = other RNA
caggtccagctcgtcgagtccggcggcggcgtcgtccagcccggccgctccctccgcctctcctgcgccgcctcccagttctccttctcctcctacggcatgcactgggtccgccaggcccccggcaagggcctcgagtgggtcgccgccatctccttcgccggcatcaagaagcactacgccgactccgtcaagggccgcttcaccatctcccgcgacaactccaagaacaccctctacctccagatgaactccctccgcgtcgaggacaccgccctctactactgcgccaaggacctccgcgagtacgagtgcgaggagtgggcctccgactactacgacttcggccgcccccagccctgccaggacccccgcggcgtcgtcggcacctccgacatctggggccagggcaccatggtcaccgtctcctcc

SEQ ID NO: 17339 - RNA, 411 nt, synthetic construct
  misc_feature 1..411: note = derived and/or modified sequence opt2 from anti-HIV_cap256-059-050520_VR-Chain
  source 1..411: mol_type = other RNA
caggtccagctcgtcgagtccggcggcggcgtcgtccagcccggccgctccctccgcctctcctgcgccgcctcccagttcaccttcaaccgctacggcatgcactgggtccgccaggcccccggcaagggcctcgagtgggtcgccgtcatctcctacgccgactccgtcaagggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggccgcgagctcccctgccgcaagtcccgcggcgtcgccggcatcttcgacatctggggccagggcaccatggtcaccgtctcctcc

SEQ ID NO: 17340 - RNA, 432 nt, synthetic construct
  misc_feature 1..432: note = derived and/or modified sequence opt2 from anti-HIV_cap256-059-049839_VR-Chain
  source 1..432: mol_type = other RNA
caggtccagctcgtcgagtccggcggcggcgtcgtccagcccggccgctccctccgcctctcctgcgccgcctccggcttctccttctccaactacgccatggactgggtccgccaggcccccggcaagggcctcgagtgggtcgccgtcgtctcctccgacggcaagaccaagaactacgccgactccgtcaagggccgcttcaccatctcccgcgacaactccaagaacaccgtctacctccagatgaactccctccgccccgaggacaccgccgtctactactgcgccaaggacctcggcgccaacaaggacgacgagtggaccaccgactactacgactggtccgtcgcctaccccgtccccgacccccgcgccgtcgtcggcgccttcgacgtctggggccagggcaccatggtcaccgtctcctcc

SEQ ID NO: 17341 - RNA, 432 nt, synthetic construct
  misc_feature 1..432: note = derived and/or modified sequence opt2 from anti-HIV_cap256-059-048503_VR-Chain
  source 1..432: mol_type = other RNA
caggtccagctcgtcgagtccggcggcggcgtcgtccagcccggccgctccctccgcctctcctgcgccgcctcccagctctccttctccaactacggcatgcactgggtccgccaggcccccggcaagggcctcgagtgggtcgccggcacctccttcgccggcaccaagaagtactacgccgactccgtcaagggccgcttcaccatctcccgcgacaactccaagaacgccctctacctccagatgaactccctccgcgccgaggacaccgccctctactactgcgccaaggacctccgcgagtacgagtgcgaggagtgggcctccgactactacgacttcggccgcgaccagccctgccaggacccccgcggcgtcgtcggcaccttcgacatctggggccagggcaccatggtcaccgtctccgcc

SEQ ID NO: 17342 - RNA, 432 nt, synthetic construct
  misc_feature 1..432: note = derived and/or modified sequence opt2 from anti-HIV_cap256-059-045516_VR-Chain
  source 1..432: mol_type = other RNA
caggtccagctcgtcgagtccggcggcggcgtcgtccagcccggccgctccctccgcctctcctgcgccgcctcccagttcaccttctccggctacggcatgcactgggtccgccaggcccccggcaagggcctcgagtgggtcgccgccatctccttcgccggcaacaagcgctacttcgccgactccgtcaagggccgcttcaccatctcccgcgacaactccaagaacaccctcttcctccagatgaactccctccgcgccgaggacaccgccctctactactgcgcccgcgacatgcgcgagtacgagtgcgaggagtgggcctccgactactacgacttcggccgcccccagccctgccaggacccccgcggcgtcgtcggcgtcttcgacatctggggccagggcaccatggtcaccgtctcctcc

SEQ ID NO: 17343 - RNA, 432 nt, synthetic construct
  misc_feature 1..432: note = derived and/or modified sequence opt2 from anti-HIV_cap256-059-044188_VR-Chain
  source 1..432: mol_type = other RNA
caggtccacctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccggcatctccttcgccggcaccaacaagtactacgccgactccgtcaagggccgcttcaccgtctcccgcgacaactccaagaacaccctctacgtccagatgaactccctccgcgccgaggacaccgccctctactactgcgcccgcgacctccgcgagtacgagtgcgaggagtgggcctccgactactacgacttcggccgcgagcagccctgccaggacccccgcggcgtcgtcggcatcttcgacatctggggccccggcaccatggtcaccgtctcctcc

SEQ ID NO: 17344 - RNA, 435 nt, synthetic construct
  misc_feature 1..435: note = derived and/or modified sequence opt2 from anti-HIV_cap256-059-044105_VR-Chain
  source 1..435: mol_type = other RNA
cagggccagctcgtcgagtccggcggcggcgtcgtccagcccggccgctccctctccctctcctgcgccgcctccggcttctccttcaacaactacgccatggactgggtccgccaggcccccggcaagggcctcgagtgggtcgccgtcgtctcctccgacggcaacaacaagaactacgccgactccgtcaagggccgcttcaccatctcccgcgacaactccaagaacaccgtctacctccagatgaactccctccgcgccgaggacaccgccatctactactgcgccaaggacgtcggcgccaacaaggacgacgagtgggccaccaactactactacgactggtccgtcgcctaccccgtccccgacccccgcgccgtcatcggcgccttcgacgtctggggccagggcaccatggtcaccgtctcctcc

SEQ ID NO: 17345 - RNA, 432 nt, synthetic construct
  misc_feature 1..432: note = derived and/or modified sequence opt2 from anti-HIV_cap256-059-042100_VR-Chain
  source 1..432: mol_type = other RNA
caggtccagctcgtcgagtccggcggcggcgtcgtccagcccggccgctcccagcgcctctcctgcgccgcctcccagttcaccttctcctcctacggcatgcactgggtccgccaggcccccggcaagggcctcgagtgggtcgccgccatctccttcgccggcaccaacaagtactacggcgactccgtcaagggccgcttcaccatctcccgcgacaactccaagaacaccctctacctccagatgaactccctccgcgccgaggacaccgccctctaccactgcgcccgcgacatgcgcgagtacgagtgcgaggagtgggcctccgactactacgacttcggccgcgaccagccctgccaggacccccgcggcgtcgtcggcatcttcgacctctggggccagggcaccatggtcaccgtctcctcc

SEQ ID NO: 17346 - RNA, 432 nt, synthetic construct
  misc_feature 1..432: note = derived and/or modified sequence opt2 from anti-HIV_cap256-059-040742_VR-Chain
  source 1..432: mol_type = other RNA
caggtccagctcgtcgagaccggcggcggcgtcggccagcccggcaagtccctccgcctctcctgcgccgcctccggcttcaccttctccaacttcgccatggactgggtccgccaggcccccggcaagggcctcgagtgggtcgccttcatctcctccgacggcatcaacaagaagtacggcgacttcgtcaagggccgcttcaccatctcccgcgacaactccaagaacaccctcttcctccagatgaactccctccgcgccgaggacaccgccctctactactgcgccaaggacgtcggcgactacaagtccgacgagtggggcaccgactactacgacctctccatcgagtaccccatccaggacccccgcgccgtcgtcggcgccttcgacaactggggccagggcaccatggtcatcgtctcctcc

SEQ ID NO: 17347 - RNA, 432 nt, synthetic construct
  misc_feature 1..432: note = derived and/or modified sequence opt2 from anti-HIV_cap256-059-040554_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccggcatctccttcgccgccaccaacaagtactacggcggctccgtcaagggccgcttcaccatctcccgcgacaactccaagaacaccctctacctccagatgaactccctccgcgccgaggacaccgccctctactactgcacccgcgacatgcgcgagtacgagtgcgaggagtgggcctccgactactacgacttcggcaaggaccagccctgccaggacccccgcggcgtcgtcggcaccctcgacatctggggccagggcaccatggtcaccgtctcctcc

SEQ ID NO: 17348 - RNA, 432 nt, synthetic construct
  misc_feature 1..432: note = derived and/or modified sequence opt2 from anti-HIV_cap256-059-039660_VR-Chain
  source 1..432: mol_type = other RNA
caggtccagctcgtcgagtccggcggcggcgtcgtccagcccggccgctccctccgcctctcctgcgccgcctcccagttctccttctccaactacggcatgcactgggtccgccaggcccccggcaagggcctcgagtgggtcgcctccatctccttcgccggcaccaagaagaagtacgccgactccgtcaagggccgcttcaccatctcccgcgacaactccaagaacaccctcttcctccagatgaactccctccgcaccgaggacgccgccctctactactgcgccaaggacatgcgcgagttcgagtgcgaggagtgggcctccgactactacgacttcggccgcgagcagccctgccaggacacccgcgacgtcgtcggcatcttcgacatctggggccagggcaccatggtcaccgtctcctcc

SEQ ID NO: 17349 - RNA, 435 nt, synthetic construct
  misc_feature 1..435: note = derived and/or modified sequence opt2 from anti-HIV_cap256-059-039298_VR-Chain
  source 1..435: mol_type = other RNA
caggtccagctcgtcgagtccggcggcggcgtcgtccagcccggccgctccctccgcctctcctgcgccgcctccggcttcaccttctccaagtacggcatgcactgggtccgccaggcccccggcaagggcctcgagtgggtcgccttcgtcgccttcgacgagtccgacaagtactacgccgcctccgccaagggccgcttcatcatctcccgcgacaactccaagaacaccctctccctccagatgaactccctccgcaccgaggacaccgccgtctactactgcgccaaggaggtcggcgacaacaaggacgacgagtggacctccccctactactacgacatctccatcgcctaccccgtccaggacccccgcgccgtcgtcggcggctacgacgtctggggccagggcaccatggtcaccgtctcctcc

SEQ ID NO: 17350 - RNA, 432 nt, synthetic construct
  misc_feature 1..432: note = derived and/or modified sequence opt2 from anti-HIV_cap256-059-037873_VR-Chain
  source 1..432: mol_type = other RNA
caggtccagctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgccgccatctccttcgccggcatcaacaagtactacgccgactccgtcaagggccgcttcaccctctcccgcgacaacaccaagaacaccctctacctccagatgaactccctccgcgccgaggacaccgccctctactactgcgcccgcgacctccgcgagtacgagtgcgaggagtgggcctccgactactacgacttcggccgcccccagccctgccaggacccccgcggcgtcgtcggcacctccgacatctggggccagggcaccatggtcaccgtctcctcc

SEQ ID NO: 17351 - RNA, 432 nt, synthetic construct
  misc_feature 1..432: note = derived and/or modified sequence opt2 from anti-HIV_cap256-059-037633_VR-Chain
  source 1..432: mol_type = other RNA
caggtccagctcgtcgagtccggcggcggcgtcgtccagcccggccgctccctccgcctctcctgcgccgcctcccagttcaccttctccaacttcggcatgcactgggtccgccaggcccccggcaagggcctcgagtgggtcgccgccatctccttcgccggcatcaacaagaactacgccgactccgtcaagggccgcttcaccatctcccgcgacaactccaagaacaccctccacctccagctcaactccctccgcgccgaggacaccgccctctactactgcgccaaggacctccgcgagtacgagtgcgaggagtgggcctccgactactacgacttcggccgcgaccagccctgccaggacccccgcggcgtcgtcggcaccttcgacatctggggccagggcaccatggtcaccgtctcctcc

SEQ ID NO: 17352 - RNA, 432 nt, synthetic construct
  misc_feature 1..432: note = derived and/or modified sequence opt2 from anti-HIV_cap256-059-036817_VR-Chain
  source 1..432: mol_type = other RNA
caggtccagctcctcgagtccggcggcggcgtcgtccagcccggccgctccctccgcctctcctgcgaggcctcccagttcaccttctccaacttcggcatgcactgggtccgccaggcccccggcaagggcctcgagtgggtcgccgccatctccttcgccggcatcaagaagaactacgccgactccgtcaagggccgcttcaccatctcccgcgacaactccaagaacaccctctacctccagatgaactccctccgcgtcgaggacaccgccctctactactgcgccaaggacctccgcgagtacgagtgcgaggagtgggcctccgactactacgacttcggccgcgagcagccctgccaggacccccgcggcgtcatcggcaccttcgacatctggggccagggcaccatggtcaccgtctcctcc

SEQ ID NO: 17353 - RNA, 432 nt, synthetic construct
  misc_feature 1..432: note = derived and/or modified sequence opt2 from anti-HIV_cap256-059-032787_VR-Chain
  source 1..432: mol_type = other RNA
caggtccagctcgtcgagtccggcggcggcgtcgtccagcccggccgctccctccgcctctcctgcgccgcctccggcttcaccttctccaagtacgccatgcactgggtccgccaggcccccggcaagggcctcgagtgggtcgccttcgtcgccttcgacgagtccgacaagtactacgtcgactccgtcaagggccgcttcaccatctcccgcgacaactccaagaacaccctctccctccagatgaactccctccgcgccgaggacaccgccgtctactactgcgccaaggaggtccacgtcaacaaggacgacgagtgggcctccgactactacgacctctccatcgcctaccccatccaggacccccgcgccgtcgtcggcggcctcgacatctggggccagggcaccatggtcaccgtctcctcc

SEQ ID NO: 17354 - RNA, 432 nt, synthetic construct
  misc_feature 1..432: note = derived and/or modified sequence opt2 from anti-HIV_cap256-059-032427_VR-Chain
  source 1..432: mol_type = other RNA
caggtccagctcgtcgagtccggcggcggcgtcgtccagcccggccgctccctccgcctctcctgcgccgcctcccagttcaccttctccaacttcggcatgcactgggtccgccaggcccccggcaagggcctcgagtgggtcgccggcatctccttccccggcaccaagaagtactacgccgactccgtcaagggccgcttcaccatctcccgcgacaactccaagaacgccctctacctccagatgaactccctccgcgccgaggacaccgccctctactactgcgcccgcgacctccgcgagtacgagtgcgaggagtgggcctccgactactacgacttcggcaagccccagccctgcctcgacccccgcggcgtcgtcggcaccttcgacatctggggccagggcaccatggtcaccgtctcctcc

SEQ ID NO: 17355 - RNA, 435 nt, synthetic construct
  misc_feature 1..435: note = derived and/or modified sequence opt2 from anti-HIV_cap256-059-029390_VR-Chain
  source 1..435: mol_type = other RNA
caggtccagctcgtcgagtccggcggcggcgtcgtccagcccggccgctccctccgcctctcctgcgccgcctccggcttcaccttcaaccagcacggcatgcactgggtccgccaggcccccgacaagggcctcgagtgggtcgccttcgtcggcttcgacgagtccgagaagtactacgccgactccgtcaagggccgcttcaccatctcccgcgacaactccaagaacaccctctccctccagatgaactccctccgccccgaggacaccgccgtctactactgcgccaaggaggtcggcgacaacaaggaggacgagtgggcctccgactactactacgacctctccaacgcctaccccatccacgacccccgcgccgtcgtcggcggctacgacatctggggccagggcaccatggtcaccgtctgctcc

SEQ ID NO: 17356 - RNA, 435 nt, synthetic construct
  misc_feature 1..435: note = derived and/or modified sequence opt2 from anti-HIV_cap256-059-027877_VR-Chain
  source 1..435: mol_type = other RNA
caggtccagctcgtcgagtccggcggcggcgtcgtccagcccggccgctccctccgcctctcctgctccgcctccgccttctccttctcctacttcgccatggactgggtccgccaggcccccggcaagggcctcgagtgggtcgccttcgtctcctccgacggcaacaacaagaactacgccgactccgtcaagggccgcttcaccatctcccgcgacaactccaagaacaccgtcttcctccagatggactccctccgccccgaggacaccgccgtctactactgcgccaaggacctcggcggcaacaaggacgacgagtggtccaccaactactactacgacatctccatcgccgaccccgtccccgacccccgcgccgtcgccggcgccttcgacgtctggggccagggcaccatggtcaccgtctcctcc

SEQ ID NO: 17357 - RNA, 435 nt, synthetic construct
  misc_feature 1..435: note = derived and/or modified sequence opt2 from anti-HIV_cap256-059-026640_VR-Chain
  source 1..435: mol_type = other RNA
caggtccagctcgtcgagtccggcggcggcgtcgtccagcccggccgctccctccgcctctcctgcgccgcctccggcttctccttctccaagtacggcatgcactgggtccgccaggcccccggcaagggcctcgagtgggtcgccttcgtcgccttcgacgagtccgaccgctactacgccgcctccgtcaagggccgcttcaccatctcccgcgacaactccaagaacaccctctccctccagatgaactccctccgcaccgaggacaccgccatctactactgcgccaaggaggtcggcgacaacaaggacgacgagtggacctccccctactactacgacatgtccatcgcctaccccgtccaggacccccgcgccgtcgtcggcggctacgacatctggggccagggcaccatggtcaccgtctcctcc

SEQ ID NO: 17358 - RNA, 432 nt, synthetic construct
  misc_feature 1..432: note = derived and/or modified sequence opt2 from anti-HIV_cap256-059-026017_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccctcatctcctacgacggcaccaacaagtactacgtcgactccgccaagggccgcttcaccatctcccgcgacaactccaagaacaccctctacctccagatgaactccctcacccccgaggacaccgccgtcttctactgcgccaaggacctcggcggctacaaggacgacgagtggggcaccgagtactacgacatctccgtctcctaccccgtccaggacccccgcgccgtcgccggcgtcttcgacgtctggggccacggcaccatggtcaccgtctcctcc

SEQ ID NO: 17359 - RNA, 432 nt, synthetic construct
  misc_feature 1..432: note = derived and/or modified sequence opt2 from anti-HIV_cap256-059-024100_VR-Chain
  source 1..432: mol_type = other RNA
tgccaggtcctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgccggcaccaagaagtactacgccgactccgtcaagggccgcttcgccatctcccgcgacacctccaagaacgccctctacctccagatgaacaccctccgcgccgaggacaccgccctctactactgcgcccgcgacctccgcgagttcgagtgcgaggagtgggcctccgactactacgacttcggccgcccccagccctgccaggacccccgcggcgtcgtcggctccttcgacatctggggccagggcaccatggtcaccgtctccctc

SEQ ID NO: 17360 - RNA, 432 nt, synthetic construct
  misc_feature 1..432: note = derived and/or modified sequence opt2 from anti-HIV_cap256-059-023966_VR-Chain
  source 1..432: mol_type = other RNA
caggtccagctcgtcgagtccggcggcggcgtcgtccagcccggccgctccctccgcctctcctgcgccgcctcccagttctccttctcctcctacggcatgcactgggtccgccaggcccccggcaagggcctcgagtgggtcgccgccatctccttcgccggcatcaagaagcactacaccgactccgtcaagggccgcttcaccatctcccgcgacaactccaagaacaccctctacctccagatgaactccctccgcgccgaggacaccgccctctactactgcgccaaggacctccgcggcttcgagtgcgaggagtgggcctccgactactacgacttcggccgcgaccagccctgccaggacccccgcggcgtcgtcggcaccttcgacatctggggccagggcaccctcgtcaccgtctcctcc

SEQ ID NO: 17361 - RNA, 432 nt, synthetic construct
  misc_feature 1..432: note = derived and/or modified sequence opt2 from anti-HIV_cap256-059-020534_VR-Chain
  source 1..432: mol_type = other RNA
caggtccagctcgtcgagtccggcggcggcgtcgtccagcccggccgctccctccgcctctcctgcgccgcctcccagttcaccttctccaactacggcatgcactgggtccgccaggcccccggcaagggcctcgagtgggtcgccggcatgtccttcgccggcaccaacacctactacgccgactccgtcaagggccgcttcaccatctcccgcgacaactccaagaacaccctctacctccagatgaactccctccgcgccgtcgacaccgccctctactactgcgcccgcgacatgcgcgagtacgagtgcgaggagtgggcctccgactactacgacttcggccgcgagtacccctgccaggacccccgcggcgtcgtcggcatcttcgacctctggggccagggcaccatggtcaccgtctcctcc

SEQ ID NO: 17362 - RNA, 435 nt, synthetic construct
  misc_feature 1..435: note = derived and/or modified sequence opt2 from anti-HIV_cap256-059-019513_VR-Chain
  source 1..435: mol_type = other RNA
caggtccagctcgtcgagtccggcggcggcgtcgtccagcccggccgctccctccgcctctcctgcgccgcctccggcttcaccttctccaacttcgccatgggctgggtccgccaggcccccggcaagggcctcgagtgggtcgccgtcatctcctccgacggcaccaacaagaactacggcgactccgtcaagggccgcttcaccatctcccgcgacaactccaagaacaccctcttcctccagatgaactccctccgcgccgaggacacctccctctactactgcgccaaggacctcggcggctacaagaccgacgagtgggccaccaactactactacgacatctccatcgcctcccccatccaggacccccgcgccgtcgtcggcgccttcgacatctggggccagggcaccatggtcaccgtcacctcc

SEQ ID NO: 17363 - RNA, 432 nt, synthetic construct
  misc_feature 1..432: note = derived and/or modified sequence opt2 from anti-HIV_cap256-059-012963_VR-Chain
  source 1..432: mol_type = other RNA
caggtccagctcgtcgagtccggcggcggcgtcgtccagcccggccgctccctccgcctctcctgcgtcgcctccggcttctccttctcctcctacggcatggcctgggtccgccaggcccccggcaagggcctcgagtgggtcaccgtcatctccttcgccggcgtcaagacctactacgccgactccgtcaagggccgcttcaccatctcccgcgacaactccaagggcaccctctacctccagatggacggcctccgccccgaggacaccgccctctactactgcgccaaggacctcgccgagcgcgagtgcgaggagtgggcctccgactactacgacttcggccgcgagctcccctgccaggacccccgcggcgtcgtcggcaccttcgacgtctggggccagggcaccatggtcaccgtctcctcc

SEQ ID NO: 17364 - RNA, 435 nt, synthetic construct
  misc_feature 1..435: note = derived and/or modified sequence opt2 from anti-HIV_cap256-059-010396_VR-Chain
  source 1..435: mol_type = other RNA
caggtccagctcgtcgagtccggcggcggcgtcgtccagcccggccgctccctccgcctctcctgcgccgcctccggcttctccttcaacaactacgccatgaactgggtccgccaggcccccggcaagggcctcgagtgggtcgccttcgtctcctccgacggctccaacaagaactacgccgactccgtcaccggccgcttcaccctctcccgcgacaactccaagaacaccgtcttcctccagatgaactccctccgcgtcgaggacaccgccgtctactactgcgccaaggacgtcggcgccaacaaggacgacgagtggaccaccaactactactacgacatctccatcgccgaccccgtccccgacccccgcgccgtcatcggcgccttcgacgtctggggccagggcaccatggtcaccgtctcctcc

SEQ ID NO: 17365 - RNA, 432 nt, synthetic construct
  misc_feature 1..432: note = derived and/or modified sequence opt2 from anti-HIV_cap256-059-008136_VR-Chain
  source 1..432: mol_type = other RNA
caggtccagctcgtcgagtccggcggcggcgtcgtccagcccggccgctccctccgcctctcctgcgccgcctccggcttcaccttcaacacctacgccatgcactgggtccgccaggcccccggcaagggcctcgagtgggtcgccctcatctcctacgacggcaccgagaagtactacgccgactccgtcaagggccgcttcaccatctcccgcgacaactcccgcaacaccctctacctccagatgaactccctccgcctcgaggacgccgccctctaccagtgcgccaaggacctcggcggctccaagtccgacgagtggggcaccgactactacgacatgtccatctcctaccccatccaggacccccgcgccgtcgccggcgtcttcgacatctggggccagggcaccctcgtcaccgtctcctcc

SEQ ID NO: 17366 - RNA, 432 nt, synthetic construct
  misc_feature 1..432: note = derived and/or modified sequence opt2 from anti-HIV_cap256-059-006147_VR-Chain
  source 1..432: mol_type = other RNA
caggtccaggtcgtcgagtccggcggcggcgtcgtccagcccggccgctccctccgcctctcctgcaccgcctccggcttcaccttctccaacttcgccatgggctgggtccgccaggcccccggcaagggcctcgagtgggtcgccttcatctcctccgacggctccaacaagaactacggcgactccgtcaagggccgcttcaccatctcccgcgacaactccaagaacaccgtcttcctccagatgaactccctccgcgtcgaggacaccgccctctactactgcgccaaggacgtcggcgactacaagtccgacgagtggggcaccgagtactacgacatctccatctcctaccccatccaggacccccgcgccatggtcggcgccttcgacctctggggccagggcaccatggtcaccgtctccccc

SEQ ID NO: 17367 - RNA, 432 nt, synthetic construct
  misc_feature 1..432: note = derived and/or modified sequence opt2 from anti-HIV_cap256-059-005081_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccggcatctccttcgccgccaccaagaagtactactccgagtccgtcaagggccgcttcaccatctcccgcgacaactccaagaacgccctccacctccacatgaactccctccgcgccgaggacaccgccctctactactgcgccaaggacctccgcgagttcgagtgcgaggagtgggcctccgactactacgacttcggccgcgaccagccctgccaggacccccgcggcgtcgtcggcatcttcgacatgtggggccagggcaccatggtcaccgtctcctcc

SEQ ID NO: 17368 - RNA, 432 nt, synthetic construct
  misc_feature 1..432: note = derived and/or modified sequence opt2 from anti-HIV_cap256-059-005006_VR-Chain
  source 1..432: mol_type = other RNA
caggcccagctcgtcgagtccggcggcggcgtcgtccagcccgccaagtccctccgcctctcctgcgccgcctccggcttcaccttcaacaagtacgccatgcactgggtccgccaggcccccggcaagggcctcgagtgggtcgccttcgtcgccttcgacgagtccgacaagtactacgccgactccgtcaagggccgcttcaccatctcccgcgacaactccaagaacaccctctccctccagatgaacaacctccgcgccgaggacaccgccgtctactactgcgccaaggaggtcggcgacaacaaggacgacgagtgggcctccgactactacgacctctccatcgcctaccccatccaggacccccgcgccgtcggccgcggctacgacatctggggccagggcaccatggtcaccgtctcctcc

SEQ ID NO: 17369 - RNA, 432 nt, synthetic construct
  misc_feature 1..432: note = derived and/or modified sequence opt2 from anti-HIV_cap256-059-004451_VR-Chain
  source 1..432: mol_type = other RNA
caggtccacctcgtcgagtccggcggcggcgtcgtccagcccggcaagtccctccgcctctcctgcaccgcctccggcttcaccttcaccaacttcgccatggactgggtccgccaggcccccggcaagggcctcgagtgggtcgccttcatctcctccgacggctccaacaagtactactccgagtccgtcaagggccgcttcaccatctcccgcgacaactccaagaacaccctctacgtccagatgaactccctccgcaccgaggacaccgccgtctactactgcgccaaggacctcggcggctacaaggacgacgagtggtccaccgactactacgactggtccaccgcctaccccgtccaggacccccgcgccgtcgccggcgccttcgacctctggggccagggcaccatggtctccgtctcctcc

SEQ ID NO: 17370 - RNA, 432 nt, synthetic construct
  misc_feature 1..432: note = derived and/or modified sequence opt2 from anti-HIV_cap256-059-003571_VR-Chain
  source 1..432: mol_type = other RNA
caggagcagctcgtcgagtccggcggcggcgtcgtccagcccggccgctccctccgcctctcctgcgccgcctcccagttcaccttcggcgcctacggcatgcactgggtccgccaggcccccggcaagggcctcgagtgggtcgccggcgtctccttcgtcggcaacaacaagtactacgccgactccgtcaagggccgcttcaccatctcccgcgacaactccaagaacaccctctacctccagatgaactccctccgcggcgaggacaccgccctctactactgcgcccgcgacatgcgcgagatggagtgcgaggagtgggcctccgactactacgacttcggccgcccccagccctgccaggacccccgcggcgtcgtcggcatcttcgacatgtggggccagggcaccatggtcaccgtctcctcc

SEQ ID NO: 17371 - RNA, 432 nt, synthetic construct
  misc_feature 1..432: note = derived and/or modified sequence opt2 from anti-HIV_cap256-059-003449_VR-Chain
  source 1..432: mol_type = other RNA
caggtccagctcgtcgagtccggcggcggcgtcgtccagcccggcaagtccctccgcctctcctgcgccgcctcccaggtcaccttctcctcctacggcatgcactgggtccgccaggcccccggcaagggcctcgagtgggtcgccggcatctccttcgccggcaccaagaagtactacgccgactccgtcaagggccgcttcaccatctcccgcgacaactccaagaacgccctctacctccagatgaaccgcctccgcgccggcgacaccgccctctactactgcgccaaggacctccgcgagtacgagtgcgaggagtgggcctccgactactacgacttcggccgcgagcagccctgccaggacccccgcggcgtcgtcggcatcttcgacatctggggcctcggcaccatggtcaccgtctcctcc

SEQ ID NO: 17372 - RNA, 432 nt, synthetic construct
  misc_feature 1..432: note = derived and/or modified sequence opt2 from anti-HIV_cap256-059-002712_VR-Chain
  source 1..432: mol_type = other RNA
caggtccagctcgccgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgccggcaccaagaagcactacgccgactccgtcaagggccgcttcaccatctcccgcgacaactccaagaacaccctcaacctccagatgaactccctccgcgccgaggacaccgccctctactactgcgcccgcgacatgcgcgagtacgagtgcgaggtctgggcctccgactactacgacttcggccgcgagcagccctgccaggacccccgcggcgtcgtcggcaccttcgacatctggggccagggcaccatggtcaccgtctccccc

SEQ ID NO: 17373 - RNA, 432 nt, synthetic construct
  misc_feature 1..432: note = derived and/or modified sequence opt2 from anti-HIV_cap256-059-001573_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccggcatctcctacgacggcacctccaagtactacgccgactccgtcaagggccgcttcaccatctcccgcgacaactccaagaacaccctctacctccagatgaactccctccgcgccgaggacaccgccctctactactgcgccaaggacctccgcgaggacgagtgcgaggagtggtggtccgactactacgacttcggccgcgagctcccctgccgcaagtcccgcggcgtcgccggcaccttcgacatctggggccacggcaccatggtcaccgtctcctcc

SEQ ID NO: 17374 - RNA, 432 nt, synthetic construct
  misc_feature 1..432: note = derived and/or modified sequence opt2 from anti-HIV_cap256-059-001379_VR-Chain
  source 1..432: mol_type = other RNA
caggtccgcctcgtcgagtccggcggcggcgtcgtccagcccggccgctccctccgcctctcctgcgccgcctccggcttcaccttcaactcctaccccatgcactgggtccgccaggcccccggcaagggcctcgactgggtcgccctcatctcctacgacggcaccaacaagttctacgtcgactccgtcaagggccgcttcaccatctcccgcgacaactccaagaacaccctctacctccagatgaactccctcaccgccgaggacaccgccatgtactactgcgccaaggacctcggcggcaacaaggacgacgagtggggcaccgactactacgacatctccgtcgcctaccccatccacgacccccgcgccgtcgccggcatcttcgacgtctggggccacggcaccatggtcaccgtctcctcc

SEQ ID NO: 17375 - RNA, 432 nt, synthetic construct
  misc_feature 1..432: note = derived and/or modified sequence opt2 from anti-HIV_cap256-059-001029_VR-Chain
  source 1..432: mol_type = other RNA
caggagcagctcgtccagtccggcggcggcgtcgtccagcccggccgctccctccgcctctcctgcgccccctcccagttcaccttctccgcccacggcatgcactgggtccgccaggcccccggcaagggcctcgagtgggtcgccggcatctccttcgccggcaccaagaactactacgccgactccgtcaagggccgcttcaccatctcccgcgacaactccaagaacaccctctacctccagatgaactccctccgcgtcgaggacaccgccctctactactgcgccaaggacatgcgcgagatggagtgcgaggagtgggcctccgactactacgacttcggccgccaccagccctgccaggacccccgcggcgtcgtcggcatcttcgacatctggggccagggcaccatggtcaccgtctcctcc

SEQ ID NO: 17376 - RNA, 432 nt, synthetic construct
  misc_feature 1..432: note = derived and/or modified sequence opt2 from anti-HIV_cap256-048-165087_VR-Chain
  source 1..432: mol_type = other RNA
gaggtcaagctcctcgagtccggcggcggcctcgtccagcccggcggctaccgccgcctctcctgcgccgcctccggcttcaccttctcccgctacgccatgcactgggcccgccaggcccccggcaagggcctcgagtgggtcgccgtcgtctccgacgacggcgtcaagaagtactaccccgactccgtccgcggccgcttcaccatctcccgcgacaactcccgcaacaccgtctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17377 - RNA, 432 nt, synthetic construct
  misc_feature 1..432: note = derived and/or modified sequence opt2 from anti-HIV_cap256-048-158861_VR-Chain
  source 1..432: mol_type = other RNA
gaggtccagctcgtcgagtccggcggcggcctcgtccagcccggcggctccctccgcctctcctgcgtcgacttcggcttccgcttctccgagtactggatgtcctgggtccgccaggcccccggcaagggcctcgagtgggtcgccgtcatctcctacgacggcaccaacaagtactacgccgactccgtcaagggccgcttcaccatctcccgcgacaactccaagaacaccctctacctccagatgaactccctccgcgccgaggacaccgccctctactactgcgccaaggacatgcgcgagtccgagtgcgaggagtgggcctccgactactacgacttcggcaaggactacccctgccaggacccccgcggcgtcgtcggcaccttcgacatctggggccagggcaccatggtcaccgtctcctcc

SEQ ID NO: 17378 - RNA, 435 nt, synthetic construct
  misc_feature 1..435: note = derived and/or modified sequence opt2 from anti-HIV_cap256-048-158280_VR-Chain
  source 1..435: mol_type = other RNA
caggtccacctcgtcgagtccggcggcggcgtcgtccagcccggccgctccctccgcatctactgcgccgtctccgagttcaccttccgcaactacgccatgcactgggtccgcctcgcccccggcaagggcctccagtgggtcgccgtcatctcccacgacggcatcaacgactactacgccgactccgtcaagggccgcttcaccatctcccgcgacaactccaagaacaccgtctccctccagatgaactccctccgccccgaggacaccgccgtctactactgcgccaaggacctcggcgccaacaaggacgacgagtgggccaccgactactacgacctctccatcgcctaccccgtccccgaccccaccggcccctggttcggcgccttcgacatctggggccagggcaccatggtcaccgtctcctcc

SEQ ID NO: 17379 - RNA, 432 nt, synthetic construct
  misc_feature 1..432: note = derived and/or modified sequence opt2 from anti-HIV_cap256-048-157928_VR-Chain
  source 1..432: mol_type = other RNA
caggtccagctcatggagtccggcggcggcgtcgtccagcccggccgctccctccgcctctcctgcgccatctccggcttcaccttctccaactactggatgtcctgggtccgccaggcccccggcaagggcctcgagtgggtcgccgtcatctcctccgacggctcctccaagaactacgccgactccgtcaagggccgcttcaccatctcccgcgacaactccaagaacaccgtctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17380 - RNA, 432 nt, synthetic construct
  misc_feature 1..432: note = derived and/or modified sequence opt2 from anti-HIV_cap256-048-157056_VR-Chain
  source 1..432: mol_type = other RNA
caggtccagctcgtcgagtccggcggcggcgtcgtccagcccggccgctccctccgcctctcctgcgccgcctccggcttcaccctctcctcctacgccatgcactgggtccgccaggcccccggcaagggcctcgagtgggtcgccttcatctccaacgacggctccaacaagtacttcgccgactccgtcaagggccgcttcaccatctcccgcgacaactccaagaacaccctctacctccagatgaactccctccgcgccgaggacaccgccgtctactactgcgccaaggacctcggcggcaacaaggacgacgagtgggccaccgactactacgacctctccatcgcctaccccgtccaggacccccgcgtcgtcgtcggcatcttcgacatctggggccagggcaccatggtcaccgtctcctcc

SEQ ID NO: 17381 - RNA, 432 nt, synthetic construct
  misc_feature 1..432: note = derived and/or modified sequence opt2 from anti-HIV_cap256-048-156422_VR-Chain
  source 1..432: mol_type = other RNA
caggtccagctcgtcgagtccggcggcaccgtcgtccagcccggccgctccctccgcctctcctgcgtcggctccggcttctccctctcctactacgccatccactgggtccgccaggcccccggcaagggcctcgagtgggtcgccgtcatctcctacgacggctccaactactactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17382 - RNA, 432 nt, synthetic construct
  misc_feature 1..432: note = derived and/or modified sequence opt2 from anti-HIV_cap256-048-152863_VR-Chain
  source 1..432: mol_type = other RNA
gaggtccagctcctcgagtccggcggcggcctcgtccagcccggcggctccctccgcctctcctgcgccggctccggcttcaccttctccaagcacggcatgcactgggtccgccaggcccccggcaagggcctcgagtgggtcgccttcgtcgccttcgacgagtccgacaagtactacgccgactccgtcaagggccgcttcaccatctcccgcgacaactccaagaacaccctctccctccagatgaactccctccgcgccgaggacaccgccatgtactactgcgccaaggaggtcggcgacaacaaggacgacgagtgggcctccgactactacgacctctccatcgcctaccccgtccacgacccccgcgccgtcgtcggcggctacgacatctggggccagggcaccatggtcaccgtctcctcc

SEQ ID NO: 17383 - RNA, 432 nt, synthetic construct
  misc_feature 1..432: note = derived and/or modified sequence opt2 from anti-HIV_cap256-048-152770_VR-Chain
  source 1..432: mol_type = other RNA
caggtccagctcgtcgagtccggcggcggcgtcgtccagcccggccgctccctccgcctctcctgcgccgcctccggcttcaccttccgctccaacgccatgcactgggtccgccaggcccccggcaagggcctcgagtgggtcgccgtcatctcctacgacggctccaagacctactacgccgactccgtcaagggccgcttcaccatctcccgcgacaactccaagaacaccctctacctccagatgaactccctccgcgccgaggacaccgccgtctactactgcgccaaggacctcggcgagtacaagtccgacgagtgggccaccgactactacgacctctccatcgcctaccccgtccaggacccccgcggcgtcgccggcgccttcgacatctggggccagggcaccatggtcaccgtctcctcc

SEQ ID NO: 17384 - RNA, 432 nt, synthetic construct
  misc_feature 1..432: note = derived and/or modified sequence opt2 from anti-HIV_cap256-048-150027_VR-Chain
  source 1..432: mol_type = other RNA
gaggtccagctcgtcgagtccggcggcggcctcgtccagcccggcggctccctccgcctctcctgcgccgtctccggcttcaccttctcctcctacatcatgcactgggtccgccaggcccccggcaagggcctcgagtgggtcgccgtcatctcctacgacggctccaacaaggactacgccgactccgtcaagggccgcttcaccatctcccgcgacaactccaagaacaccctctacctccagatgaactccctccgcgccgaggacaccgccctctactactgcgccaaggacctccgcgagtacgagtgcgaggagtgggcctccgactactacgacttcggccgcgactacccctgccaggacccccgcggcgtcgtcggcaccttcgacatctggggccagggcaccatggtcaccgtctcctcc

SEQ ID NO: 17385 - RNA, 432 nt, synthetic construct
  misc_feature 1..432: note = derived and/or modified sequence opt2 from anti-HIV_cap256-048-148246_VR-Chain
  source 1..432: mol_type = other RNA
caggtccagctcgtcgagtccggcggcggcgtcgtccagcccggccgctccctccgcctctcctgcgccacctccggcttcaccttctccacctactccatgcactgggtccgccaggcccccggcaagggcctcgagtgggtcgccgtcatctcctacgacggctccaacgagtactacgtcgactccgtcaagggccgcttcaccatctcccgcgacaactccaagaacaccctctacctccagatgaactccctccgcgtcgaggacaccgccctctactactgcgccaaggacctcggcggcaacaaggacgacgagtggggcaccgactactacgacttctccgtcgcctaccccgtccaggacccccgcgccgtctccggcatcttcgacgtctggggccacggcaccatggtcaccgtctcctcc

SEQ ID NO: 17386 - RNA, 432 nt, synthetic construct
  misc_feature 1..432: note = derived and/or modified sequence opt2 from anti-HIV_cap256-048-147428_VR-Chain
  source 1..432: mol_type = other RNA
caggtccagctcgtcgagtccggcggcggcgtcgtccagcccggccgctccctccgcctctcctgctccgcctccggcttcaccttctccaactacggcatgcactgggtccgccaggcccccggcaagggcctcgagtgggtcgccgtcatctccttcgacggctccaacaaggtctacgccgactccgtcaagggccgcttcaccatctcccgcgacaactccaagaacaccctctacctcgagatgaactccctccgcgccgaggacaccgccgagtactactgcgccaaggacctcggcgagtccgacaaggaggagtggccctccgactactacgacttcggccgcgacttcaccggccaggtcccccgcgccgtcgtcggcatcttcgacatgtggggccagggcaccatggtcaccgtctcctcc

SEQ ID NO: 17387 - RNA, 432 nt, synthetic construct
  misc_feature 1..432: note = derived and/or modified sequence opt2 from anti-HIV_cap256-048-146603_VR-Chain
  source 1..432: mol_type = other RNA
gaggtccagctcgtcgagtccggcggcggcctcgtccagcccggccgctccctccgcctctcctgcgccgcctccggcttcaccttcgacgactacgccatccactgggtccgccaggcccccggcaagggcctcgagtgggtcgccctcatctcctacgacggcaccgacaagtactacgccgactccgtcaagggccgcttcaccatctcccgcgacaactccaagaacaccctctacctccagatgaactccctccgcgtcgaggacaccgccgtctaccactgcgccaaggacctcggcggcaccaagtccgacgagtgggccaccgactactacgacctctccatcgcctaccccatccaggaccccggcgccgtcgtcggcgtcttcgacatctggggccagggcaccatggtcaccgtctcctcc

SEQ ID NO: 17388 - RNA, 432 nt, synthetic construct
  misc_feature 1..432: note = derived and/or modified sequence opt2 from anti-HIV_cap256-048-145735_VR-Chain
  source 1..432: mol_type = other RNA
caggtccagctcgtccagtccggcggcggcgtcgtccagcccggccgctccctccgcctctcctgcggcgcctccggcttcaccttctccaactacgccatgcactgggtccgccaggcccccggcaagggcctcgactgggtcgccgtcatctcctacgacggcaccaacgagaaccacgccgactccgtcaagggccgcttcaccatctcccgcgacaactccaagaacaccgtctacctccagatgaactccctccgcgccgaggacaccgccgtctactactgcgccaaggacgtcggcggctccaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17389 - RNA, 432 nt, synthetic construct
  misc_feature 1..432: note = derived and/or modified sequence opt2 from anti-HIV_cap256-048-145116_VR-Chain
  source 1..432: mol_type = other RNA
caggtccacctcgtcgagtccggcggcggcgtcgtccagcccggcggctccctccgcctctcctgcgccgcctccggcttcaccttctccaactacggcatgcactgggtccgccaggcccccggcaagggcctcgagtgggtcgccgccatctccttcgccggcaccaacaagtactacgccgactccgtcaagggccgcttcaccatctcccgcgacaactccaagaacgccctctacctccagatgaactccctccgcgccgaggacaccgccctctactactgcgccaaggacctccgcgagtccgagtgcgaggagtgggcctccgactactacgacttcggccgcgactacccctgccaggacccccgcggcgtcgtcggcaccctcgacatctggggccagggcaccatggtcaccgtctcctcc

SEQ ID NO: 17390 - RNA, 432 nt, synthetic construct
  misc_feature 1..432: note = derived and/or modified sequence opt2 from anti-HIV_cap256-048-144077_VR-Chain
  source 1..432: mol_type = other RNA
caggtcaagctcgtcgagtccggcggcggcgtcgtccagcccggccgctccctccgcctctcctgcgccgcctccggcttcaccctctcctcctacgccatgcactgggtccgccaggcccccggcaagggcctcgagtgggtcgccgtcatctcctacgacggctccaaccgctacaccgccgactccgtcaagggccgcttcaccatctcccgcgacaactccaagaacaccctcaacctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccaccgtcaccgtctcctcc

SEQ ID NO: 17391 - RNA, 432 nt, synthetic construct
  misc_feature 1..432: note = derived and/or modified sequence opt2 from anti-HIV_cap256-048-142876_VR-Chain
  source 1..432: mol_type = other RNA
caggtccagctcgtcgagtccggcggcggcgtcgtccagcccggcggctccctccgcctctcctgcgtcgcctccggcttcaccttctccacctacggcatgcactgggtccgccaggcccccggcaagggcctcgagtgggtcgccttcatgcgcttcgacggctccaaccgctactacggcgactccgtcaagggccgcttcaccatctcccgcgacaactccaagaacaccctctacctccagatgatctccctccgcgccgaggacaccgccgtctaccactgcgccaaggacctcggcggcaacaagcccgacgagtgggccaccgactactacgacctctccatcgcctaccccgtccaggacccccgcgccgtcgtcggcgtcttcgacatctggggccagggcaccatcatcaccgtctcctcc

SEQ ID NO: 17392 - RNA, 432 nt, synthetic construct
  misc_feature 1..432: note = derived and/or modified sequence opt2 from anti-HIV_cap256-048-140582_VR-Chain
  source 1..432: mol_type = other RNA
caggtccagctcgtcgagtccggcggcggcgtcgtccagcccggccgctccctccgcctctcctgcgccgcctccggcttctccttctccaactacgccatggactgggtccgccaggcccccggcaagggcctcgagtgggtcgccttcgtctcctccgacggctccaacaagaactacgccgactccgtcaagggccgcttcaccatctcccgcgacaactccaagaacaccgtctacctccagatgaactccctccgcgtcgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17393 - RNA, 432 nt, synthetic construct
  misc_feature 1..432: note = derived and/or modified sequence opt2 from anti-HIV_cap256-048-139355_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccatcatctcctacgacggctccaacaagtactacgccgactccgtcaagggccgcttcaccatctcccgcgacaactccaagggcaccctctacctccagatggacggcccccgccccgaggacaccgccctctactactgcgccaaggacctcggcgagcgcgagtgcgaggagtgggcctccgactactacgacttcggccgcgacttcccctgccaggacccccgcggcgtcgtcggcaccttcgacatctggggccagggcaccatggtcaccgtctcctcc

SEQ ID NO: 17394 - RNA, 432 nt, synthetic construct
  misc_feature 1..432: note = derived and/or modified sequence opt2 from anti-HIV_cap256-048-139151_VR-Chain
  source 1..432: mol_type = other RNA
caggtccagctcgtcgagtccggcggcggcgtcgtccagcccggcaagtccctccgcctctcctgcgccgcctccggcttcaccttcaacacctacggcatgcactgggtccgccaggcccccggcaagggcctcgagtgggtcgccgtcatctcctacgacggctccatccagaagtacgccgactccgtcaagggccgcttcaccatctcccgcgacaactccaagaacaccctctacctccagatgaactccctctccgtcgaggacaccgccgtctactactgcgccaaggacctcggcaagaacaaggacgacgagtgggccaccgactactacgacatctccatcgcctaccccgtccccgacccccgcgccgtcgtcggcgtcttcgacatctggggccagggcaccgtcgtcaccgtctcctcc

SEQ ID NO: 17395 - RNA, 432 nt, synthetic construct
  misc_feature 1..432: note = derived and/or modified sequence opt2 from anti-HIV_cap256-048-137672_VR-Chain
  source 1..432: mol_type = other RNA
gaggtccagctcgtcgagtccggcggcggcgtcgcccgccccggcggctccctccgcctctcctgcgccgcctccggcttcatcttcacccactacgccatggactgggtccgccaggcccccggcaagggcctcgagtgggtcgccgtcatctcctccgacggctcctccaagaactacgccgactccgtcaagggccgcttcaccatctcccgcgacaactccaagaacaccgtctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17396 - RNA, 432 nt, synthetic construct
  misc_feature 1..432: note = derived and/or modified sequence opt2 from anti-HIV_cap256-048-137506_VR-Chain
  source 1..432: mol_type = other RNA
caggtccgcctcgtcgactccggcggcggcgtcgtccagcccggcggctccctccgcctctcctgcgccgcctccggcttcaccttctccacctacggcatgcactgggtccgccaggcccccggcaagggcctcgagtgggtcgccttcatccgctccgacggctccaacaagtactacgccgactccgtccagggccgcttctccatctcccgcgacaactccaagaacaccctctacctccagatgaactccctccgcgccgaggacaccgccgtctactactgcgccaaggacctcggcgagtccgacaaggaggagtggccctccgactactacgacttcggccgcgacttcaccggccaggacccccgcgccgtcgtcggcgtcttcgacatctggggccagggcaccaccgtcatcgtctcctcc

SEQ ID NO: 17397 - RNA, 432 nt, synthetic construct
  misc_feature 1..432: note = derived and/or modified sequence opt2 from anti-HIV_cap256-048-137270_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatgtcccccgacggctccaaccgctactacaccgactccgtcaagggccgcttcaccatctcccgcgacaactccaagaacaccctctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17398 - RNA, 432 nt, synthetic construct
  misc_feature 1..432: note = derived and/or modified sequence opt2 from anti-HIV_cap256-048-135447_VR-Chain
  source 1..432: mol_type = other RNA
gaggtccagctcgtcgagtccggcggcgccgtcgtccagcccggccgctccctccgcctctcctgcaccgcctccggcttctccttcacctcctacaccatccactgggtccgccaggcccccggcaagggcctcgagtgggtcgccttcatctcctacgacggcaccgagaagaagtacaccgactccgtcaagggccgcttcaccatctcccgcgacaactccaagaacaccctctccctccagatgaactccctccgccccgaggacaccgccgtctactactgcgccaaggacctcggcgcctccaaggacgacgagtgggccaccgactactacgacttctccatcgcctaccccgtccaggacccccgcgccgtcgtcggcgccttcgacatctggggccagggcaccatggtcaccgtctcctcc

SEQ ID NO: 17399 - RNA, 432 nt, synthetic construct
  misc_feature 1..432: note = derived and/or modified sequence opt2 from anti-HIV_cap256-048-131966_VR-Chain
  source 1..432: mol_type = other RNA
caggagcagctcgtcgagtccggcggcggcgtcgtccagcccggccgctccctccgcctctcctgcgccgcctccggcttcaccttctccaactacgccatgcactgggtccgccaggcccccggcaagggcctcgagtgggtcgccgccatgtcccacgacggctccgacaagtactacgccgactccgtcaagggccgcttcaccatctcccgcgacaactccaagaacaccctctacatgcagatgaactccctccgcgccgaggacaccgccgtctactactgcgccaaggaccagggcgagtccgagaaggaggagtgggcctccgactactacgacttcggccgcgactaccccggccaggacccccgccgcgtcgtcgccaccttcgccatctggggccagggcaccatggtcaccgtctcctcc

SEQ ID NO: 17400 - RNA, 432 nt, synthetic construct
  misc_feature 1..432: note = derived and/or modified sequence opt2 from anti-HIV_cap256-048-131008_VR-Chain
  source 1..432: mol_type = other RNA
gaggtccgcctcgtcgagtccggcggcggcctcgtcaagcccggcggctccctccgcctctcctgcgccgcctccggcttcaccgtctcctccaactacatgtcctgggtccgccaggcccccggcaagggcctcgagtgggtcgccgccatctccttcgccggcaccaacaagtactacgccgactccgtcaagggccgcttcaccatctcccgcgacaactccaagaacgccctctacctccagatgaactccctccgcgccgaggacaccgccctctactactgcgccaaggacctccgcgagtccgagtgcgaggagtgggcctccgactactacgacttcggccgcgactacccctgccaggacccccgcggcgtcgtcggcaccctcgacatctggggccagggcaccatggtcaccgtctcctcc

SEQ ID NO: 17401 - RNA, 432 nt, synthetic construct
  misc_feature 1..432: note = derived and/or modified sequence opt2 from anti-HIV_cap256-048-129369_VR-Chain
  source 1..432: mol_type = other RNA
caggtccagctcgtcgagtccggcggcggcgtcgtccagcccggccgctccctccgcctctcctgcgccgcctccggcttcaccttctccaactacgtcatgcactgggtccgccaggcccccggcaagggcctcgagtgggtcgccctcgtctccttcgacggctccaacaagtactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17402 - RNA, 432 nt, synthetic construct
  misc_feature 1..432: note = derived and/or modified sequence opt2 from anti-HIV_cap256-048-128476_VR-Chain
  source 1..432: mol_type = other RNA
gaggtccaggtcctcgagtccggcggcggcctcgtccagcccggcggctccctccgcctcgcctgcgccgcctccggcttctccttctcctcctacggcatgcactgggtccgccaggcccccggcaagggcctcgagtgggtctccttcatccgctacgacggcgccaacaagtaccacgccgactccgtcaagggccgcttcatcatctcccgcgacgactccaagaacaccgtctccctccagatgaactccctccgccccgaggacaccgccgtctactactgcgccaaggacctcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17403 - RNA, 432 nt, synthetic construct
  misc_feature 1..432: note = derived and/or modified sequence opt2 from anti-HIV_cap256-048-128270_VR-Chain
  source 1..432: mol_type = other RNA
caggtccagctcgtcgagtccggcggcggcgtcgtccagcccggccgctccctccgcctctcctgcaccgcctccggcttcaccttccgctcctacgccatgcactgggtccgccaggcccccggcaagggcctcgagtgggtcgccctcatctcctacgacggctccaacaagtactacgccgactccgtcaagggccgcttcaccatctcccgcgacaactccaagaacaccctctacctccagatgaactccctcacctccgaggacaccgccgtctactactgcgccaaggacctcggcggctccaagaccgacgagtggggcaccgactactacgagttctggaacgcctaccccgtccaggacccccgcgtcgtcgtcggcgccttcgacatctggggccacggcaccatggtcaccgtctcctcc

SEQ ID NO: 17404 - RNA, 432 nt, synthetic construct
  misc_feature 1..432: note = derived and/or modified sequence opt2 from anti-HIV_cap256-048-126220_VR-Chain
  source 1..432: mol_type = other RNA
caggtccagctcgtcgagtccggcggcggcgtcgtccagcccggccgctccctccgcctctcctgcgccgcctccggcttcatcttctccccctacggcatccactgggtccgccaggcccccggcaagggcctcgagtgggtcgccctcatctcccacgacggctccaagaagtactacgccgactccgtcaagggccgcttcaccatctcccgcgacaacttcaaggacaccctctacctccagatgaactccctccgcggcgtcgacaccgccgtctactactgcgccaaggacctcggcggcggcgaggtcgaggagtgggccaccgactactacgactggtccaccgcctaccccgtcgagcacccccgcgccgtcgtcggcgtcttcgacatctggggccagggcaccaaggtcaccgtctcctcc

SEQ ID NO: 17405 - RNA, 432 nt, synthetic construct
  misc_feature 1..432: note = derived and/or modified sequence opt2 from anti-HIV_cap256-048-125713_VR-Chain
  source 1..432: mol_type = other RNA
gaggtccagctcgtcgagtccggcggcggcctcgtccagcccggcggctccctccgcctctcctgcgaggcctccggcttctccttctccacctacgagctcaactgggtccgccaggcccccggcaagggcctcgagtgggtcgccgtcatctcctacgacggctccaactactactacgccgactccgtcaagggccgcttcaccatctcccgcgacaactccaagaacaccctctacctccagatgaactccctccgcgccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17406 - RNA, 432 nt, synthetic construct
  misc_feature 1..432: note = derived and/or modified sequence opt2 from anti-HIV_cap256-048-123934_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatggcctgggtccgccaggcccccggcaagggcctcgagtgggtcaccgccatctccttcgccggcaccaacaagtactacgccgactccgtcaagggccgcttcaccatctcccgcgacaactccaaggacaccctctacctccagatggacggcctccgccccgaggacaccgccctctactactgcgccaaggacctcggcgagcgcgagtgcgaggagtgggcctccgactactacgacttcggccgcgacttccccggccaggaccagcgcgccgtcgccggcgtcttcgacatgtggggccagggcaccatggtcaccgtctcctcc

SEQ ID NO: 17407 - RNA, 432 nt, synthetic construct
  misc_feature 1..432: note = derived and/or modified sequence opt2 from anti-HIV_cap256-048-122673_VR-Chain
  source 1..432: mol_type = other RNA
gaggtccaggtcgtcgagtccggcggcggcctcgtcaagcccggcggctccctccgcctctcctgcgccgcctccggcttcaccttctcctcccacgtcatgaactgggtccgccaggcccccggcaagggcctcgagtgggtctcctccatctccggcggctcctcctccaaggactacgccgactccgtcaagggccgcttcaccatctcccgcgacaactccaagaacaccctctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17408 - RNA, 432 nt, synthetic construct
  misc_feature 1..432: note = derived and/or modified sequence opt2 from anti-HIV_cap256-048-122208_VR-Chain
  source 1..432: mol_type = other RNA
cgcgtccaggtcgtcgagtccggcggcggcgtcgtcaagcccggcggctccctccgcctctcctgcggcgcctccggcttcaccttctccaacgcctggctctcctgggtccgccaggcccccggcaagggcctcgagtgggtcgccgtcatctcctccgacggctcctccaagaactacgccgactccgtcaagggccgcttcaccatctcccgcgacaactccaagaacaccgtctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17409 - RNA, 432 nt, synthetic construct
  misc_feature 1..432: note = derived and/or modified sequence opt2 from anti-HIV_cap256-048-121552_VR-Chain
  source 1..432: mol_type = other RNA
caggtccagctcgtcgagtccggcggcggcgtcgtccagcccggcggctccctccgcctctcctgcgccgcctccggcttcaccttctcctcctacgccatgcactgggtccgccaggcccccggcaagggcctcaagtgggtcgccgacatctcctacgacgcctcctccaagtactacgccgactccgtcaagggccgcttcaccatctcccgcgacaactccaagaacaccctctacctcgagatgaactccctccgccccgaggacaccgccgtctactactgcgccaaggacctcggcgagcgcgagtgcgaggagtgggcctccgactactacgacttcggccgcgacttcccctgccaggacccccgcggcgtcgtcggcaccttcgacatctggggccagggcaccatggtcaccgtctcctcc

SEQ ID NO: 17410 - RNA, 432 nt, synthetic construct
  misc_feature 1..432: note = derived and/or modified sequence opt2 from anti-HIV_cap256-048-120643_VR-Chain
  source 1..432: mol_type = other RNA
caggtccagctcgtcgagtccggcggcggcgtcgtccagcccggccgctccctccgcctctcctgcgccgcctccggcttcaccctctccgcctacaccatgcactgggtccgccaggcccccggcaagggcctcgagtgggtctccgtcatctccttcgccggcaacaacaagtactacgccgactccgtcaagggccgcttcaccatctcccgcgagaactccaagaacatgctctacctccagatgaactccctccgcggcgaggacaccgccgtctactactgcgccaaggacctccgcgagttcgagtgcgaggagtgggcctccgactactacgacttcggccgcgactacccctgccaggacccccgcggcgtcgtcggcaccttcgacgtctggggccacggctccctcgtcaccgtctcctcc

SEQ ID NO: 17411 - RNA, 432 nt, synthetic construct
  misc_feature 1..432: note = derived and/or modified sequence opt2 from anti-HIV_cap256-048-118458_VR-Chain
  source 1..432: mol_type = other RNA
caggtccagctcgtcgagtccggcggcggcgtcgtccagcccggccgctccctccgcctctcctgcgccgcctccggcttcaccttctccacctccggcatgcactgggtccgccaggcccccggcaagggcctcgagtgggtcgccttcatctcctccgaccgctccaacaagttctacgccgactccgtcaagggccgcttctccatctcccgcgacaactccaagtacaccctctacctccagatgaactccctccgcgccgacgacaccgccgtctacttctgcgccaaggacctcggcgtcaacaagaacgacgagtgggccaccgactactacgacctctccgtcgcctaccccgtccaggacccccgcggcgtcgccggcatcttcgacatctggggccagggcaccatggtcaccgtctcctcc

SEQ ID NO: 17412 - RNA, 432 nt, synthetic construct
  misc_feature 1..432: note = derived and/or modified sequence opt2 from anti-HIV_cap256-048-118112_VR-Chain
  source 1..432: mol_type = other RNA
caggagcagctcgtcgagtccggcggcggcgtcgtccagcccggccgctccctccgcctctcctgcgccgcctcccagttcaccttctccaactacggcatgcactgggtccgccaggcccccggcaagggcctcgtctgggtcgccggcatctccttcgccggcaccaacaagtactacgccgcctccgtcaagggccgcttcaccatctcccgcgacaactccaagaacaccctctacctccagatgaactccctccgcgccgaggacaccgccctctactactgcgccaaggacatgcgcgagtacgagtgcgaggagtgggcctccgactactacgacttcggccgcgactacccctgccaggacccccgcggcgtcgtcggcaccttcgacatctggggccagggcaccatggtcaccgtctcctcc

SEQ ID NO: 17413 - RNA, 432 nt, synthetic construct
  misc_feature 1..432: note = derived and/or modified sequence opt2 from anti-HIV_cap256-048-116469_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccatcatctcctacgacggctccaacaagtactacgccgactccgtcaagggccgcttcaccatctcccgcgacaaccccaagaacaccctctacctccagatgaactccctccgcgccgaggacaccggcctctactactgcgccaaggacatgggcgagtccgagaaggaggagtgggcctccgactactacgacttcggccgcgactaccccggccaggagccccgcgccatggtcggcaccttcgacatctggggccagggcaccatggtcaccgtctcctcc

SEQ ID NO: 17414 - RNA, 432 nt, synthetic construct
  misc_feature 1..432: note = derived and/or modified sequence opt2 from anti-HIV_cap256-048-113917_VR-Chain
  source 1..432: mol_type = other RNA
gaggtccagctcgtcgagtccggcggcggcctcgtccagcccggcggctccctccgcctctcctgcgccgcctccggcctcaccgtctccgacacctacatgaactggctccgccaggcccccggcaagggcctcgagtgggtcgccgtcgtctcctccgacggctccaacaagaactacgccgactccgtcaagggccgcttcaccatctcccgcgacaactccaagaacaccgtctacctccagatgaactccctccgcgccgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17415 - RNA, 432 nt, synthetic construct
  misc_feature 1..432: note = derived and/or modified sequence opt2 from anti-HIV_cap256-048-112368_VR-Chain
  source 1..432: mol_type = other RNA
caggtccagctcgtcgagtccggcggcggcgtcgtccagcccggccgctccctccgcctctcctgcgccgcctccggcttcaccttctcccgcaacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcggcggcgaggtcgaggagtgggccaccgactactacgactggtccaccgcctaccccgtcgagcacccccgcgccgtcgtcggcgtcttcgacatctggggccagggcaccaaggtcaccgtctcctcc

SEQ ID NO: 17416 - RNA, 432 nt, synthetic construct
  misc_feature 1..432: note = derived and/or modified sequence opt2 from anti-HIV_cap256-048-112047_VR-Chain
  source 1..432: mol_type = other RNA
gaggtccagctcgtcgagtccggcggcggcctcgtccagcccggcggctccctccgcctctcctgcgccgcctccggcctcaccgtctccggctactacatgtcctgggtccgccaggcccccggcaagggcctcgagtggctcgccttcatccacttcgacggctccaagatccactacgccggctccgtcaagggccgcatcaccgtctcccgcgacaactccaagaacaccctcgacctccagatgaactccctccgcgccgaggacaccgccgtctactactgcgccaaggacgtcggcgactccaagtccgacgagtgggccaccgactactacgacctctccgtcgcctaccccgtccccgacccccgcgccgtcgtcggcgccttcgacatctggggccagggcaccatggtcaccgtctcctcc

SEQ ID NO: 17417 - RNA, 432 nt, synthetic construct
  misc_feature 1..432: note = derived and/or modified sequence opt2 from anti-HIV_cap256-048-112029_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccggcatctccttcgccggcatcaagaagtactacgccgactccgtcaagggccgcttcaccatctcccgcgacaactccaagaacaccctctacctccagatgaactccctccgcggcgaggacaccgccctctactactgcgccaaggacctccgcgagtacgagtgcgaggagtgggcctccgactactacgacttcggccgcgactacccctgccaggacccccgcggcgtcgtcggcatcttcgacatctggggccagggcaccatggtcaccgtctcctcc

SEQ ID NO: 17418 - RNA, 432 nt, synthetic construct
  misc_feature 1..432: note = derived and/or modified sequence opt2 from anti-HIV_cap256-048-110957_VR-Chain
  source 1..432: mol_type = other RNA
caggtccgcctcgtcgagtccggcggcggcgtcgtccgctccggccgctccctccgcctctcctgcgccgcctccggcttcaccttctccaacttcgccctccactgggtccgccaggcccccggcaagggcctcgagtgggtcgccgtcatctcctacgacggcaactccaagttctacgccgactccgtcaagggccgcttcaccatctccaccgacaactccaagaacaccctctacctccagatgaactccctcaccgccgaggacaccgccgtctactactgcgccaaggacctcggcggcaacaaggacgacgagtggggcaccgactactacgacttctccgtcgcctaccccgtccaggacccccgcgccgtctccggcatcttcgacgtctggggccacggcaccatggtcaccgtctcctcc

SEQ ID NO: 17419 - RNA, 432 nt, synthetic construct
  misc_feature 1..432: note = derived and/or modified sequence opt2 from anti-HIV_cap256-048-110526_VR-Chain
  source 1..432: mol_type = other RNA
caggtccagctcgtcgagtccggcggcggcgtcgtccagcccggccgctccctccgcctctcctgcgccgcctccggcttcaccttctccaacttcggcttccactgggtccgccaggcccccggcaagggcctcgagtgggtcgccgccatctccttcgccggcaacaacaagtactacgccgactccgtcaagggccgcttcaccatctcccgcgagaactccaagaacatcctctacctccagatgaactccctccgcggcgaggacaccgccgtctactactgcgccaaggacctccgcgagttcgagtgcgaggagtgggcctccgactactacgactggtccaccgcctaccccgtcgagcacccccgcgccgtcgtcggcgtcttcgacatctggggccagggcaccaaggtcaccgtctcctcc

SEQ ID NO: 17420 - RNA, 432 nt, synthetic construct
  misc_feature 1..432: note = derived and/or modified sequence opt2 from anti-HIV_cap256-048-109336_VR-Chain
  source 1..432: mol_type = other RNA
gaggtccagctcgtcgagtccggcggcggcctcgtccagcccggcggctcccagcgcctctcctgcgccgcctccggcctcaccgtcaactccaactacatgacctgggtccgccaggcccccggcaagggcctcgagtgggtcgccatcatctcctccgacggctccggccagtactacgccgactccgtcaagggccgcttcaccatctcccgcgacaactccaagaacaccctctccctccagatgaactccctccgccccgaggacaccgccgtctactactgcgccaaggacctcggcgcctccaaggacgacgagtgggccaccgactactacgacttctccatcgcctaccccgtccaggacccccgcgccgtcgtcggcgccttcgacatctggggccagggcaccatggtcaccgtctcctcc

SEQ ID NO: 17421 - RNA, 432 nt, synthetic construct
  misc_feature 1..432: note = derived and/or modified sequence opt2 from anti-HIV_cap256-048-108152_VR-Chain
  source 1..432: mol_type = other RNA
caggcccagctcgtcgagtccggcggcggcgtcgtccagcccggccgctccctcgtcctctcctccgtcgcctccggcttctccttctccacctacgccatgcactgggtccgccaggcccccggcaagggcctcgagtgggtcgccgtcatctcctacgacggcggcaacaagtactacgccgactccgtcaagggccgcttctccatctcccgcgacaactccaagaacaccgtctacctccagatcaactccctccgcgccgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17422 - RNA, 432 nt, synthetic construct
  misc_feature 1..432: note = derived and/or modified sequence opt2 from anti-HIV_cap256-048-107799_VR-Chain
  source 1..432: mol_type = other RNA
gaggtccaggtcgtcgagtccggcggcggcgtcgtccagcccggccgctccctccgcctctcctgcgccgcctccggcttcaccttctccaactacgccatggactgggtccgccaggcccccggcaagggcctcgagtgggtcgccttcgtctcctccgacggctccaacaagaactacgccgactccgtcaagggccgcttcaccatctcccgcgacaactccaagaacaccctctccctccagatgaactccctccgcgccgaggacaccgccgtctactactgcgccaaggaggtcggcgagaacaaggacgacgagtgggcctccgactactacgacctctccatcgcctaccccatccacgacccccgcgccgtcgtcggcggcttcgacatctggggccagggcaccatggtcaccgtctcctcc

SEQ ID NO: 17423 - RNA, 432 nt, synthetic construct
  misc_feature 1..432: note = derived and/or modified sequence opt2 from anti-HIV_cap256-048-107384_VR-Chain
  source 1..432: mol_type = other RNA
gaggtccgcctcgtcgagtccggcggcgccctcgtcaagcccggcacctccctccgcctctcctgcgccgcctccggcttcaccttcacccactacgccatggactgggtccgccaggcccccggcaagggcctcgagtgggtcgccatcatctcctccgacggctccaccaagaactacgccgactccgtcaagggccgcttcaccatctcccgcgacaactccaagaacaccctctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17424 - RNA, 432 nt, synthetic construct
  misc_feature 1..432: note = derived and/or modified sequence opt2 from anti-HIV_cap256-048-106530_VR-Chain
  source 1..432: mol_type = other RNA
gaggtccagctcctcgagtccggcggcggcctcgtccagcccggcggctccctccgcctctcctgcgccgcctccggcttcaccttctcctcctacgccatggactgggtccgccaggcccccggcaagggcctcgagtgggtcgccgtcatctcctccgacggctccaacaagaactacgccgactccgtcaagggccgcttcaccatctcccgcgacaactccaagaacaccctctacctccagatgtcctccctccgccccgaggacaccgccgtctactactgcgccaaggacgtcggcgactccaagtccgacgagtgggccaccgactactacgacttctccatcgcctaccccatccaggacccccgcgccgtcgtcggcgccttcgacatctggggccagggcaccatggtcaccgtctcctcc

SEQ ID NO: 17425 - RNA, 432 nt, synthetic construct
  misc_feature 1..432: note = derived and/or modified sequence opt2 from anti-HIV_cap256-048-106464_VR-Chain
  source 1..432: mol_type = other RNA
gaggtccagatggtccagtccggcggcggcctcgtccagcccggcggctccctccgcctctcctgcgccgccttcggcttcaccttcaccaaccacgccatggactgggtccgccaggtccccggcaagggcctcgagtgggtcgccttcatctcctccgacggctccaacaagaactacgccgactccgtcaagggccgcttcaccatctcccgcgacaactccaagaacaccgtctacctccagatgtcctccctccgccccgaggacaccgccgtctactactgcgccaaggacgtcggcgactccaagtccgacgagtgggccaccgactactacgacctctccgtcgcctaccccgtccccgacccccgcgccgtcgtcggcgccttcgacatctggggccagggcaccatggtcaccgtctcctcc

SEQ ID NO: 17426 - RNA, 432 nt, synthetic construct
  misc_feature 1..432: note = derived and/or modified sequence opt2 from anti-HIV_cap256-048-106411_VR-Chain
  source 1..432: mol_type = other RNA
caggtccagctcgtcgagtccggcggcggcgtcgtccagcccggccgctccctccgcctctcctgcgccgcctccggcttcaccttctcctactccggcatgcactgggtccgccaggcccccggcaagggcatggagtgggtcgccgtcatctcctacgacggctccaacaagtactacgccgactccgtcaagggccgcttcaccatctcccgcgacaactccaagaacaccctctacctccagatgaactccctccgcgtcgaggacaccgccgtctaccactgcgccaaggacctcggcggcaccaagtccgacgagtgggccaccgactactacgacctctccatcgcctaccccatccaggaccccggcgccgtcgtcggcgtcttcgacatctggggccagggcaccatggtcaccgtctcctcc

SEQ ID NO: 17427 - RNA, 432 nt, synthetic construct
  misc_feature 1..432: note = derived and/or modified sequence opt2 from anti-HIV_cap256-048-106306_VR-Chain
  source 1..432: mol_type = other RNA
gaggtccagctcgtcgagtccggcggcggcctcgtccagcccggcggctccctccgcctctcctgcgaggcctccggcttcaccttcaacaactacggcatggtctgggtccgccaggcccccggcaagggcctcgagtgggtcgccatcatctcctacgacggcaccgagaagtactacgtcgactccgtcaagggccgcttcaccatctcccgcgacaactccaagaacaccctctccctccagatgaactccctccgcgccgaggacaccgccgtctactactgcgccaaggaggtcggcgagaacaaggacgacgagtgggcctccgactactacgacctctccatcgcctaccccatccacgacccccgcgccgtcgtcggcggcttcgacatctggggccagggcaccatggtcaccgtctcctcc

SEQ ID NO: 17428 - RNA, 432 nt, synthetic construct
  misc_feature 1..432: note = derived and/or modified sequence opt2 from anti-HIV_cap256-048-104496_VR-Chain
  source 1..432: mol_type = other RNA
caggtccagctcgtcgagtccggcggcggcctcgtcaagcccggcggctccctccgcctctcctgcgccgcctccggcttcaccttctcctcctacggcatgcactgggtccgccaggcccccggcaagggcctcgagtgggtcgccttcgtctcctccgacggcaacaacaagaactacgccgactccgtcaagggccgcttcaccatctcccgcgacaactccaagaacaccgtctacctccagatgaactccctccgcgtcgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17429 - RNA, 432 nt, synthetic construct
  misc_feature 1..432: note = derived and/or modified sequence opt2 from anti-HIV_cap256-048-103074_VR-Chain
  source 1..432: mol_type = other RNA
caggtccacctcgtcgagtccggcgccggcgtcgtccagcccggcggctccctccgcctctcctgcgccgtctccggcttcaccttcaactcctacggcatgcactgggtccgccaggcccccggcaagggcctcgagtgggtcgccgtcatctcctacgacggctccgacaagtactacgccgactccgtcaagggccgcttcaccatctcccgcgactcctccaagaacaccctctacctccagatgaactccctccgcgtcgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17430 - RNA, 432 nt, synthetic construct
  misc_feature 1..432: note = derived and/or modified sequence opt2 from anti-HIV_cap256-048-100832_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcgtctcctccgacggcaccaacaagaactacggcgactccgtcaagggccgcttcaccatctcccgcgacaactcccgcaacaccgtctacctccagatgtcctccctccgccccgaggacaccgccgtctactactgcgccaaggacgtcggcgacaccaagtccgacgagtgggccaccgactactacgacttctccatcgcctaccccgtccaggacccccgcgccgtcgtcggcgccttcgacatctggggccagggcaccatggtcaccgtctcctcc

SEQ ID NO: 17431 - RNA, 432 nt, synthetic construct
  misc_feature 1..432: note = derived and/or modified sequence opt2 from anti-HIV_cap256-048-100188_VR-Chain
  source 1..432: mol_type = other RNA
caggtccacctcgtcgagtccggcggcggcgtcgtccagcccggccgctccctccgcatctactgcgccgtctccgagttcaccttccgcaactacgccatgcactgggtccgcctcgcccccggcaagggcctccagtgggtcgccgtcatctcctacaacggcggcaagaagtactacgccgactccgtcaagggccgcttcaccatctcccgcgacaactccaagaacgccctctacctccagatgaactccctccgcgccgaggacaccggcctctactactgcgccaaggacctccgcgagttcgagtgcgaggagtgggcctccgactactacgacttcggccgcgagtacccctgccaggacccccgcggcgtcgtcggcaccttcgacatctggggccagggcaccatggtcaccgtctcctcc

SEQ ID NO: 17432 - RNA, 432 nt, synthetic construct
  misc_feature 1..432: note = derived and/or modified sequence opt2 from anti-HIV_cap256-048-099645_VR-Chain
  source 1..432: mol_type = other RNA
caggtccagctcgtcgagtccggcggcggcgtcgtccagcccggccgctccctccgcctctcctgcgccgcctccggcttcaccttctcccgctacgccctccactgggtccgccaggcccccggcaagggcctcgagtgggtcgccgtcatctcctacgacggctcctccaagtactacgccgactccgtcaagggccgcttctccatctcccgcgacaactccaagtacaccctctacctccagatgaactccctccgcgccgacgacaccgccgtctacttctgcgccaaggacctcggcgtcaacaagaacgacgagtgggccaccgactactacgacctctccgtcgcctaccccgtccaggacccccgcggcgtcgccggcatcttcgacatctggggccagggcaccatggtcaccgtctcctcc

SEQ ID NO: 17433 - RNA, 432 nt, synthetic construct
  misc_feature 1..432: note = derived and/or modified sequence opt2 from anti-HIV_cap256-048-098137_VR-Chain
  source 1..432: mol_type = other RNA
caggtccagctcgtcgagtccggcggcggcgtcgtccagcccggccgctccctccgcctctcctgcgccgcctccggcttcaccctccgcaactacgccatgcactgggtccgccaggcccccggcaagggcctcgagtgggtcgccgtcatctcctccgacggcaacaacaagtactacgccgactccgtcaagggccgcttcaccgtctcccgcgacaactccaaggacaccctctacctccagatgaactccctccgccccgaggacaccgccctctactactgcgccaaggacctcggcgagcgcgagtgcgaggagtgggcctccaactactacgacttcggccgcgactacccctgccaggacccccgcggcgtcgtcggcaccttcgacatctggggccagggcaccatggtcaccgtctcctcc

SEQ ID NO: 17434 - RNA, 432 nt, synthetic construct
  misc_feature 1..432: note = derived and/or modified sequence opt2 from anti-HIV_cap256-048-097878_VR-Chain
  source 1..432: mol_type = other RNA
caggtccagctcctcgagtccggcggcggcgtcgtccagcccggcaagtccctccgcctctcctgcgccgcctccggcttcaccttcaacacctacggcatgcactgggtccgccaggcccccggcaagggcctccagtgggtcgccgtcatctcctacgacggcaccatccagaagtacgccgactccgtcaagggccgcttcaccatctcccgcgagaactccaagaacatgctctacctccagatgaactccctccgcggcgaggacaccgccgtctactactgcgccaaggacctccgcgagttcgagtgcgaggagtgggcctccgactactacgacttcggccgcgactacccctgccaggacccccgcggcgtcgtcggcaccttcgacgtctggggccacggctccctcgtcaccgtctcctcc

SEQ ID NO: 17435 - RNA, 432 nt, synthetic construct
  misc_feature 1..432: note = derived and/or modified sequence opt2 from anti-HIV_cap256-048-097510_VR-Chain
  source 1..432: mol_type = other RNA
caggtccagctcgtcgagtccggcggcggcgtcgtccagcccggccgctccctctggctctcctgcgccgcctccgagttcaccctccgctcctacggcatgcactgggtccgccaggcccccggcaagggcctcgagtgggtcgccttcgtcgccttcgacgagtccgacaagtactacgccgactccgtcaagggccgcttcaccatctcccgcgacaactccaagaacaccctctccctccagatgaactccctccgcgccgaggacaccgccgtctactactgcgccaaggaggtcggcgacaacaaggacgacgagtgggcctccgactactacgacctctccatcgcctaccccgtccacgacccccgcgccgtcgtcggcggcttcgacatctggggccagggcaccatggtcaccgtctcctcc

SEQ ID NO: 17436 - RNA, 432 nt, synthetic construct
  misc_feature 1..432: note = derived and/or modified sequence opt2 from anti-HIV_cap256-048-097313_VR-Chain
  source 1..432: mol_type = other RNA
caggtccagctcgtcgagtccggcggcggcctcgtccagcccggcggcgccctccgcctctcctgcctcgtctccggcttcaccttcgacgactacgccctccactgggtccgccaggcccccggcaagggccccgagtgggtcgccgtcctctcctccgacggctcctacaagtactacaccgagtccgtccagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17437 - RNA, 432 nt, synthetic construct
  misc_feature 1..432: note = derived and/or modified sequence opt2 from anti-HIV_cap256-048-096626_VR-Chain
  source 1..432: mol_type = other RNA
gaggtccagctcgtcgagtccggcggcggcctcgtccagcccggcgagtccctccgcctctcctgcgccggctccggcttcaccttctcctcctactggatgtcctgggtccgccaggcccccggcaagggcctcgagtggatggccctcatctcctacgacggctccaacaagtactacgtcgactccgtcaagggccgcttcaccatctcccgcgacaactccaagaacaccctctacctccagatgaactccctccgcgccgaggacaccgccgtctactactgcgccaaggacctcggcggcaacaaggacgacgagtgggccaccgactactacgacctctccatcgcctaccccgtccaggacccccgcgtcgtcgtcggcatcttcgacatctggggccagggcaccatggtcaccgtctcctcc

SEQ ID NO: 17438 - RNA, 432 nt, synthetic construct
  misc_feature 1..432: note = derived and/or modified sequence opt2 from anti-HIV_cap256-048-096483_VR-Chain
  source 1..432: mol_type = other RNA
gaggtccagctcgtcgagtccggcggcggcctcgtccagcccggccgctccctccgcctctcctgcgccgcctccggcttctccttcgaggactacgccatgcactgggtccgccaggcccccggcaagggcctcgagtgggtcgccggcatctccttcgccggcaccaagaagtactacgccgactccgtcaagggccgcttcaccatctcccgcgacaactccaagaacgccctctacctccagatgaactccctccgcgccgaggacaccgccctctactactgcgccaaggacctccgcgagtacgagtgcgaggagtgggcctccgactactacgacttcggccgcgactacccctgccaggacccccgcggcgtcgtcggcaccttcgacatctggggccagggcaccatggtcaccgtctcctcc

SEQ ID NO: 17439 - RNA, 432 nt, synthetic construct
  misc_feature 1..432: note = derived and/or modified sequence opt2 from anti-HIV_cap256-048-095691_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatggcctgggtccgccaggcccccggcaagggcctcgagtgggtcaccgccatctccttcgccggcaccaacaagtactacgccgactccgtcaagggccgcttcaccatctcccgcgacaactccaaggacaccctctacctccagatggacggcctccgccccgaggacaccgccctctactactgcgccaaggacctcggcgagcgcgagtgcgaggagtgggcctccaactactacgacttcggccgcgactacccctgccaggacccccgcggcgtcgtcggcaccttcgacatctggggccagggcaccatggtcaccgtctcctcc

SEQ ID NO: 17440 - RNA, 432 nt, synthetic construct
  misc_feature 1..432: note = derived and/or modified sequence opt2 from anti-HIV_cap256-048-095525_VR-Chain
  source 1..432: mol_type = other RNA
caggtccagctcgtccagtccggcggctccgtcgtccagcccggcaagtccctccgcctctcctgcgccgcctccggcttcaccttctcctccttcggcatgcactgggtccgccagacccccggcaagggcctcgagtgggtcgccgtcatctcctacgacggctccgagaagtcctacgccgactccgtcaagggccgcttcaccatctcccgcgacaactccaagaacaccctctacctccagatgaactccctccgcgccgaggacaccgccgtctactactgcgccaaggacctcggcggcaccaaggacgacgagtgggccaccgactactacgacatctccatcgcctaccccgtccaggacccccgcgccgtcgccggcgccttcgacatctggggccagggcaccatggtcaccgtctcctcc

SEQ ID NO: 17441 - RNA, 432 nt, synthetic construct
  misc_feature 1..432: note = derived and/or modified sequence opt2 from anti-HIV_cap256-048-094783_VR-Chain
  source 1..432: mol_type = other RNA
gaggtccagctcgtcgagtccggcggcggcctcgtcaagcccggcggctccctccgcctctcctgcgccgcctccggcatcaccttctccacctacgagatgaactgggtccgccaggcccccggcaagggcatggagtgggtcgccgtcatctcctacgacggctccaacaagtactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17442 - RNA, 432 nt, synthetic construct
  misc_feature 1..432: note = derived and/or modified sequence opt2 from anti-HIV_cap256-048-094356_VR-Chain
  source 1..432: mol_type = other RNA
caggtccagctcgtcgagtccggcggcggcgtcgtccagcccggccgctccctccgcctctcctgcgccgcctccggcttcatcttcacccactacgccatggactgggtccgccaggcccccggcaagggcctcgagtgggtcgccgtcatctcctccgacggctcctccaagaactacgccgactccgtcaagggccgcttcaccatctcccgcgacaactccaagaacaccgtctccctccagatgaactccctccgccccgaggacaccgccgtctactactgcgccaaggacgtcggcgacaacaagtccgacgagtgggccaccgactactacgacttctccatcgcctaccccgtccccgacccccgcgccgtcgtcggcgccttcgacctctggggccagggcaccatggtcaccgtctcctcc

SEQ ID NO: 17443 - RNA, 432 nt, synthetic construct
  misc_feature 1..432: note = derived and/or modified sequence opt2 from anti-HIV_cap256-048-090756_VR-Chain
  source 1..432: mol_type = other RNA
caggtccagctcgtcgagtccggcggcggcgtcgtccgccccggccgctccctccgcctctcctgcgccgtctccggcttcaccttctccaactacgccatccactgggtccgccaggcccccggcaagggcctcgagtgggtcgccgtcatctcctacgacggctccgacaagtactacgccgactccgtcaagggccgcttcaccatctcccgcgagaactccaagaacatgctctacctccagatgaactccctccgcggcgaggacaccgccgtctactactgcgccaaggacctccgcgagttcgagtgcgaggagtgggcctccgactactacgacttcggccgcgactacccctgccaggacccccgcggcgtcgtcggcaccttcgacgtctggggccacggctccctcgtcaccgtctcctcc

SEQ ID NO: 17444 - RNA, 432 nt, synthetic construct
  misc_feature 1..432: note = derived and/or modified sequence opt2 from anti-HIV_cap256-048-089065_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccctcatctcctacgacggcaccaacaagtactacgtcgactccgtcaagggccgcttcaccatctcccgcgacaactccaagaacaccctctacctccagatgaactccctcaccgccgaggacaccgccgtctactactgcgccaaggacctcggcggcaacaaggacgacgagtggggcaccgactactacgacttctccgtcgcctaccccgtccaggacccccgcgccgtctccggcatcttcgacgtctggggccacggcaccatggtcaccgtctcctcc

SEQ ID NO: 17445 - RNA, 432 nt, synthetic construct
  misc_feature 1..432: note = derived and/or modified sequence opt2 from anti-HIV_cap256-048-084986_VR-Chain
  source 1..432: mol_type = other RNA
caggtccagctcgtcgagtccggcggcggcgtcgtccagcccggccgctccctccgcctctcctgcgccgcctccggcttcaccttctccgactacgccatgcactgggtccgccaggcccccggcaagggcctcgagtgggtcgccctcatctcctacgacggctccaacaagtactacgccgactccgtcaagggccgcttcaccatctcccgcgacaactccaagaacaccctctacctccagatgtcctccctcaccgccgaggacaccgccgtctactactgcgccaaggacctcggcggcaacaagaacgacgagtgggccaccgactactacgacctctccatcgcctaccccatccacgacccccgcgccgtcctcggcgccttcgacgtctggggccagggcaccatgctcaccgtctcctcc

SEQ ID NO: 17446 - RNA, 432 nt, synthetic construct
  misc_feature 1..432: note = derived and/or modified sequence opt2 from anti-HIV_cap256-048-083355_VR-Chain
  source 1..432: mol_type = other RNA
caggtccagctcgtcgagtccggcggcggcgtcgtccagcccggccgctccctccgcctctcctgcgccgtctccggcttcatcttctcctcctacgccatgcgctgggtccgccaggcccccggcaagggcctcgagtgggtcgccgtcatctcctacgacggctccaagaccaactacgccgactccgtcaagggccgcttcaccatctcccgcgacaactccaagaacaccctctacctccagatgaactccctcacctccgaggacaccgccgtctactactgcgccaaggacctcggcggctccaagaccgacgagtggggcaccgactactacgagttctggaacgcctaccccgtccaggacccccgcgtcgtcgtcggcgccttcgacatctggggccacggcaccatggtcaccgtctcctcc

SEQ ID NO: 17447 - RNA, 432 nt, synthetic construct
  misc_feature 1..432: note = derived and/or modified sequence opt2 from anti-HIV_cap256-048-082462_VR-Chain
  source 1..432: mol_type = other RNA
caggtccacctcgtcgagtccggcggcggcgtcgtccagcccggcaagtccctccgcctctcctgcaccgcctcccgcttcatcttccgcaactacgccatggactgggtccgccaggcccccggcaagggcctcgagtgggtcgccgtcatctcctacgacggcgtcaaggagcactacgccgagtccgtcaagggccgcttcaccatctcccgcgacaactccaagaacaccgtctacctccagatgaactccctccgcgtcgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17448 - RNA, 432 nt, synthetic construct
  misc_feature 1..432: note = derived and/or modified sequence opt2 from anti-HIV_cap256-048-082246_VR-Chain
  source 1..432: mol_type = other RNA
caggtccacctcgtcgagtccggcggcggcgtcgtccagcccggccgctccctccgcatctcctgcgccgcctccggcttcaccttctccaagaacgccatgcactgggtccgccaggcccccggcaagggcctcgagtgggtcgccttcgtcgccttcgacgagtccgacaagtactacgccgactccgtcaagggccgcttcaccatctcccgcgacaactccaagaacatcctctccctccagatgaactccctccgcgccgaggacaccgccgtctactactgcgccaaggaggtcgacgagtacaaggacgacgagtgggcctccgactactacgacctctccatcgcctaccccgtccgcgacccccgcgccgtcgtcggcggcttcgacatctggggccagggcaccatggtcaccgtctccgcc

SEQ ID NO: 17449 - RNA, 432 nt, synthetic construct
  misc_feature 1..432: note = derived and/or modified sequence opt2 from anti-HIV_cap256-048-080752_VR-Chain
  source 1..432: mol_type = other RNA
caggtccagctcgtcgagtccggcggcggcgtcgtccagcccggcggctccctccgcctctcctgcgccgcctccggcttcaccttctccaactacggcatgcactgggtccgccaggcccccggcaagggcctcgagtgggtcgccttcatccgctacgacggcgacatcacctactacgtcgactccgtcaagggccgcttcaccatctcccgcgacaactccaagaacgccctctacctccagatgaactccctccgcgccgaggacaccgccctctactactgcgccaaggacctccgcgagtacgagtgcgaggagtgggcctccgactactacgacttcggccgcgagtacccctgccaggacccccgcggcgtcgtcggcaccttcgacatctggggccagggcaccatggtcaccgtctcctcc

SEQ ID NO: 17450 - RNA, 435 nt, synthetic construct
  misc_feature 1..435: note = derived and/or modified sequence opt2 from anti-HIV_cap256-048-078409_VR-Chain
  source 1..435: mol_type = other RNA
caggtccagctcgtcgagtccggcggcggcgtcgtccagcccggccgctccctccgcctctcctgcgccgcctccggcttcaccttcaacaactacgccatggactgggtccgccaggcccccggcaagggcctcgagtgggtcgccctcatctcctacgacggctccaacaagtactacgccgagtccgtcaagggccgcttcaccatctcccgcgacaactccaagaacaccctctacctccagatgaactccctccgcgccgaggacaccgccgtctactactgcgccaaggacgtcggcgagaagcagtccatgatgcgctgggccaccgactactacgacctctccatcgcctaccccgtccccgacccccgcgccgtcgtcggcgccttcgacctctggggccgcggcaccatggtcaccgtctcctcc

SEQ ID NO: 17451 - RNA, 432 nt, synthetic construct
  misc_feature 1..432: note = derived and/or modified sequence opt2 from anti-HIV_cap256-048-078273_VR-Chain
  source 1..432: mol_type = other RNA
gaggtccagctcgtcgagtccggcggcggcctcgtccagcccggcggctccctccgcctctcctgcgccgcctccggcttcaccgtctcctccaactacatgtcctgggtccgccaggcccccggcaagggcctcgagtgggtcgccgtcatctcctccgacggctccaacaagaactacgccgactccgtcaagggccgcttcaccatctcccgcgacaactccaagaacaccctcttcctccagatgaactccctccgccccgaggacaccgccgtctacttctgcgccaaggacctcggcgccaacaaggacgacgagtgggccaccgactactacgacctctccatcgcctaccccgtccacgacccccgcgccgtcgtcggcatcttcgacctctggggccagggcaccatggtcaccgtctcctcc

SEQ ID NO: 17452 - RNA, 432 nt, synthetic construct
  misc_feature 1..432: note = derived and/or modified sequence opt2 from anti-HIV_cap256-048-078062_VR-Chain
  source 1..432: mol_type = other RNA
gacgtctacctcgtcgagtccggcggcggcctcgtccagcccggcggctccctccgcctctcctgcaccgcctccggcatcaccttctccacctacgagatgaactgggtccgccaggcccccggcaagggcctcgagtgggtcgccttcgtcgccttcgacggctccgacaagtactacgccgactccgtcaagggccgcttcgtcatctcccgcgacaactccaagaacaccctctccctccagatgaactccctccgcgccgaggacaccgccgtctactactgcgccaaggaggtcggcgaggacaaggacgacgagtgggcctccgactactacgacctctccatcgcctaccccgtccacgacccccgcgccgtcgtcggcggcttcgacatctggggccagggcaccatggtcaccgtctcctcc

SEQ ID NO: 17453 - RNA, 432 nt, synthetic construct
  misc_feature 1..432: note = derived and/or modified sequence opt2 from anti-HIV_cap256-048-077798_VR-Chain
  source 1..432: mol_type = other RNA
caggtccagctcgtcgagtccggcggcggcgtcgtccagcccggccgctccctccgcctctcctgcgccgcctccggcttcaccttctccaactacggcatgcactgggtccgccagacccccggcaagggcctcgagtgggtcgccgtcatctcctacgacggctccaacaagttctacgccgactccgtcaagggccgcttcaccatctcccgcgacaactccaagaacaccctctacctccagatgaactccctccgcgtcgaggacaccgccgtctaccactgcgccaaggacctcggcggctccaagtccgacgagtgggccaccgactactacgactggtccatcgcctaccccgtccacgacccccgcgccgtcgtcggcgtcttcgacatctggggccagggcaccctcgtcaccgtctcctcc

SEQ ID NO: 17454 - RNA, 432 nt, synthetic construct
  misc_feature 1..432: note = derived and/or modified sequence opt2 from anti-HIV_cap256-048-073853_VR-Chain
  source 1..432: mol_type = other RNA
gaggtccagctcgtcgagtccggcggcggcctcgtcaagcccggcggctccctccgcctctcctgcgccgcctccggcttcaccttctccgacgcctggatgaactgggtccgccaggcccccggcaagggcctcgagtgggtcgccggcatctccttcgccggcaccaacaagtactacgccgactccgtcaagggccgcttcaccatctcccgcgacaactccaagaacaccctctacctccagatgaactccctccgcgccgaggacaccgccctctactactgcgccaaggacatgcgcgagtacgagtgcgaggagtgggcctccgactactacgacttcggccgcgactacccctgccaggacccccgcggcgtcgtcggcaccttcgacatctggggccagggcaccatggtcaccgtctcctcc

SEQ ID NO: 17455 - RNA, 435 nt, synthetic construct
  misc_feature 1..435: note = derived and/or modified sequence opt2 from anti-HIV_cap256-048-071661_VR-Chain
  source 1..435: mol_type = other RNA
caggtccagctcgtcgagtccggcggcggcgtcgtccagcccggccgctccctcggcctctcctgcgaggtctccggcttcaccttctccgactacttcatgtcctggatccgccaggcccccggcaagggcctcgagtgggtcgccgtcatctcccacgacggcaacaacaagtactaccccgactccgtccagggccgcttcaccatctcccgcgagaactccaagaacaccctctacctccagatgaactccctcaagcccgaggacaccgccgtctacttctgcgccaaggacctcggcggcgagtccgaggtcgaggagtgggcctccgactactacgacttcggccgcgacatccccggccccgacccccgcggcgtcgtcggcaccctcgacatctggggccacggcaccatggtcaccgtctcctcc

SEQ ID NO: 17456 - RNA, 432 nt, synthetic construct
  misc_feature 1..432: note = derived and/or modified sequence opt2 from anti-HIV_cap256-048-071360_VR-Chain
  source 1..432: mol_type = other RNA
caggtccagctcgtcgagtccggcggcggcgtcgtccagcccggccgctccctccgcctctcctgcgccgcctccggcttcaccctcaccaactacgccatggactgggtccgccaggcccccggcaagggcctcgagtgggtcgccgtcatctcctccgacggctccaacaagaactacgaggactccgtcaagggccgcttcaccatctcccgcgacaactccaagaacaccctctacctccagatgtcctccctccgccccgaggacaccgccgtctactactgcgccaaggacgtcggcgacaacaagtccgacgagtgggccaccgactactacgacttctccatcgcctaccccgtccccgacccccgcgccgtcgtcggcgccttcgacctctggggccagggcaccatggtcaccgtctcctcc

SEQ ID NO: 17457 - RNA, 432 nt, synthetic construct
  misc_feature 1..432: note = derived and/or modified sequence opt2 from anti-HIV_cap256-048-070955_VR-Chain
  source 1..432: mol_type = other RNA
gaggtccagctcgtcgagtccggcggcggcctcgtccagcccggcggctccgtccgcctctcctgcgccgtctccggcttcaccttctcctcctactggatgtcctgggtccgccaggcccccggcaagggcctcgagtgggtcgccgtcatctccgactccggctccaacaagtactacgccgactccgtcaagggccgcttcaccatctcccgcgacaactccaagaacaccctctacctccagatgaactccctccgcgccgaggacaccgccgtctacttctgcgccaaggacctcggcggccgcgagaccgaggagtgggcctccgactactacgacttcggccgcgacttccccggccaggaccagcgcgccgtcgccggcgtcttcgacatgtggggccagggcaccatggtcaccgtctcctcc

SEQ ID NO: 17458 - RNA, 432 nt, synthetic construct
  misc_feature 1..432: note = derived and/or modified sequence opt2 from anti-HIV_cap256-048-070061_VR-Chain
  source 1..432: mol_type = other RNA
gaggtccagctcctcgagtccggcggcggcctcgtccagcccggcggctccctccgcctctcctgcgccgcctccggcttcaccttctcctcctacgccatgcactgggtccgccaggcccccggcaagggcctcgagtgggtcgccgtcacctcctacgacggctccaacaagtactacgccgactccgtcaagggccgcttcaccatctcccgcgacaactccaagaacaccctctacatgcagatgaactccctccgcgccgaggacaccgccgtctactactgcgccaaggaccagggcgagtccgagaaggaggagtgggcctccgactactacgacttcggccgcgactaccccggccgcgacccccgccgcgtcgtcgccaccttcgccatctggggccagggcaccatggtcaccgtctcctcc

SEQ ID NO: 17459 - RNA, 432 nt, synthetic construct
  misc_feature 1..432: note = derived and/or modified sequence opt2 from anti-HIV_cap256-048-069669_VR-Chain
  source 1..432: mol_type = other RNA
caggtccagctcgtcgagtccggcggcggcgtcgtccagcccggccgctccctccgcctctcctgcgccgtctccggcttcaccttctccaagttccccatgcactgggtccgccaggcccccggcaagggcctcgagtgggtcgccgtcatctcctacgacggcaacaagaagtactacgtcgactccgccaagggccgcttcaccatctcccgcgacaactcccgcaagaccctctacctccagatgaccggcctccgccccgaggacaccgccgtctactactgcgccaaggacctcggcggcggcgagtgcgagacctgggcctccgactactacgacttcggcaaggactacccctgcctcgacccccgcgacgtcgtcggcaccttcgacatctggggccagggcaccctcgtcaccgtctcctcc

SEQ ID NO: 17460 - RNA, 432 nt, synthetic construct
  misc_feature 1..432: note = derived and/or modified sequence opt2 from anti-HIV_cap256-048-069205_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgtcgtcatctccaacgacggcaacaacaagtactacgccgactccgtcaagggccgcttcaccatctcccgcgacaactccaagaacaccgtctacctccagatgaactccctccgcgccgaggacaccgccgtctactactgcgccaaggacgtcggcgacaccaagaaggacgagtgggccaccgactactacgacctctccatcgcctaccccgtccaggacccccaggccgtcgtcggcgccttcgacatctggggccagggcaccatggtcaccgtctcctcc

SEQ ID NO: 17461 - RNA, 432 nt, synthetic construct
  misc_feature 1..432: note = derived and/or modified sequence opt2 from anti-HIV_cap256-048-068882_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccctcatctcctacgacggcaccgacaagtactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccaccgcctaccccgtcgagcacccccgcgccgtcgtcggcgtcttcgacatctggggccagggcaccaaggtcaccgtctcctcc

SEQ ID NO: 17462 - RNA, 432 nt, synthetic construct
  misc_feature 1..432: note = derived and/or modified sequence opt2 from anti-HIV_cap256-048-067764_VR-Chain
  source 1..432: mol_type = other RNA
gaggtccagctcgtccagtccggcggcggcctcgtcaagcccggcggctccctccgcctctcctgcgccgcctccggcttcaccttctccacctactccatgaactgggtccgccaggcccccggcaagggcctcgagtgggtcgccgtcatctcctccgacggctcctccaagaactacgccgactccgtcaagggccgcttcaccatctcccgcgacaactccaagaacaccgtctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17463 - RNA, 432 nt, synthetic construct
  misc_feature 1..432: note = derived and/or modified sequence opt2 from anti-HIV_cap256-048-066845_VR-Chain
  source 1..432: mol_type = other RNA
caggtcctcctcgtcgagtccggcggcggcgtcgtccagcccggcggctccctcaccctctcctgcgccgcctccggcttcaccttctccaactacggcatgcactgggtccgccaggcccccggcaagggcctcgagtgggtcgccttcatccgctacgacggcaacaacaagtactacgccgactccgtcaagggccgcttcaccatctcccgcgacaactccaaggacaccctctacctccagatggacggcctccgccccgaggacaccgccctctactactgcgccaaggacctcggcgagcgcgagtgcgaggagtgggcctccaactactacgacttcggccgcgactacccctgccaggacccccgcggcgtcgtcggcaccttcgacatctggggccagggcaccatggtcaccgtctcctcc

SEQ ID NO: 17464 - RNA, 432 nt, synthetic construct
  misc_feature 1..432: note = derived and/or modified sequence opt2 from anti-HIV_cap256-048-065226_VR-Chain
  source 1..432: mol_type = other RNA
gaggtccagctcgtcgagtccggcggcggcctcgtcaagcccggcggctccctccgcctctcctgcgtcgcctccggcttcaccttctccaactacggcatgcactgggtccgccaggcccccggcaagggcctcgtctgggtcgccggcatctccttcgccggcaccaacaagtactacgccgcctccgtcaagggccgcttcaccatctcccgcgacaactccaagaacaccctctacctccagatgaactccctccgcgccgaggacaccgccctctactactgcgccaaggacatgcgcgagtacgagtgcgaggagtgggcctccgactactacgacttcggccgcgactacccctgccaggacccccgcggcgtcgtcggcaccttcgacatctggggccagggcaccatggtcaccgtctcctcc

SEQ ID NO: 17465 - RNA, 432 nt, synthetic construct
  misc_feature 1..432: note = derived and/or modified sequence opt2 from anti-HIV_cap256-048-063717_VR-Chain
  source 1..432: mol_type = other RNA
caggtccagctcgtcgagtccggcggcggcgtcgtccagcccggccgctccctccgcctctcctgcgccgcctccggcttctccttctccaaccacgccatggactgggtccgccaggcccccggcaagggcctcgagtgggtcgccgtcatctcctccgacggctccgacaagatctacgccgagtccgtcaagggccgcttcaccatctcccgcgacaactccaagaacaccctctacctccagatgaactccctccgcgtcgaggacaccgccgtctacttctgcgccaaggacctcggcgccaacaaggacgacgagtgggccaccgactactacgacctctccatcgcctaccccgtccccgacccccgcgccgtcgtcggcgccttcgacatctggggccagggcaccatggtctccgtctcctcc

SEQ ID NO: 17466 - RNA, 432 nt, synthetic construct
  misc_feature 1..432: note = derived and/or modified sequence opt2 from anti-HIV_cap256-048-063150_VR-Chain
  source 1..432: mol_type = other RNA
gaggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgcccacatccgctacgacggctccaacaagtactacatcgactccgtccagggccgcttcaccatctcccgcgacaaccccaagaacaccctctacctccagatgaactccctccgcaccgaggacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17467 - RNA, 432 nt, synthetic construct
  misc_feature 1..432: note = derived and/or modified sequence opt2 from anti-HIV_cap256-048-062431_VR-Chain
  source 1..432: mol_type = other RNA
caggtccagctcgtcgagtccggcggcggcgtcgtccagcccggccgctccctccgcctctcctgcgccgcctccggcttcaccttctccaacttcgccatggactgggtccgccaggcccccggcaagggcctcgagtgggtcgccgtcatctcctccgacggctccaagaagaactacggcgactccgtcaagggccgcttcaccatctcccgcgacaactccaagaacaccctcttcctccagatgaactccctccgccccgaggacaccgccctctactactgcgccaaggacctcggcggctacaagtccgacgagtgggccaccgactactacgacctctccatcgcctaccccgtccaggacccccgcccctggctcgagctcctctacatctggggccagggcgccatggtcaccgtctcctcc

SEQ ID NO: 17468 - RNA, 432 nt, synthetic construct
  misc_feature 1..432: note = derived and/or modified sequence opt2 from anti-HIV_cap256-048-060745_VR-Chain
  source 1..432: mol_type = other RNA
caggtccagctcgtcgagtccggcggctccgtcgtccagcccggccgctccctccgcctcacctgcaccgcctccggcttcaccttctcccactacgccatggactgggtccgccaggcccccggcaagggcctcgagtgggtcgccgtcatctcctccgacgccaccaacaagaactacgccgactccgtcaagggccgcttcaccatctcccgcgacaactccaagaacaccgtctacctccagatggactccctccgcgccgaggacaccgccgtctactactgcgccaaggacgtcggcgactacaaggacgacgagtgggccaccgactactacgacttctccatcgcctaccccgtccccgacccccgcgccgtcgtcggcgccttcgacttctggggccagggcaccatggtcaccgtctcctcc

SEQ ID NO: 17469 - RNA, 432 nt, synthetic construct
  misc_feature 1..432: note = derived and/or modified sequence opt2 from anti-HIV_cap256-048-060420_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatggcctgggtccgccaggcccccggcaagggcctcgagtgggtcaccgtcatctccttcgccggcgtcaagaagtactacgccgactccgtcaagggccgcttcaccatctcccgcgacaactccaagggcaccctctacctccagatgaactccctccgcgccgaggacaccgccgtctactactgcgccaaggacgtcggcgacaccaagaaggacgagtgggccaccgactactacgacctctccatcgcctaccccgtccaggacccccaggccgtcgtcggcgccttcgacatctggggccagggcaccatggtcaccgtctcctcc

SEQ ID NO: 17470 - RNA, 435 nt, synthetic construct
  misc_feature 1..435: note = derived and/or modified sequence opt2 from anti-HIV_cap256-048-060014_VR-Chain
  source 1..435: mol_type = other RNA
caggtccagctcgtcgagtccggcggcggcgtcgtccagcccggccgctccctccgcctctcctgcgccgcctccggcttcaccttctccaactacggcatgcactgggtccgccaggcccccggcaagggcctcgagtgggtcgccctcatctcccacgacggctccaacaagaacttcgccgactccgtcaagggccgcttcaccatctcccgcgacaactccaagaacaccctctacctccagatgaactccctccgcaccgaggacaccgccatctactactgcgccaaggacctcggcggcgagtccgagatcgaggagtggccctccgactactacgacttcggccgcgactaccccgtccccgacccccgcggcgtcgtcggcaccttcgacttctggggccagggcaccatggtcaccgtctcctcc

SEQ ID NO: 17471 - RNA, 432 nt, synthetic construct
  misc_feature 1..432: note = derived and/or modified sequence opt2 from anti-HIV_cap256-048-059747_VR-Chain
  source 1..432: mol_type = other RNA
caggtccagctcgtcgagtccggcggcggcgtcgtccagcccggccgctccctccgcctctcctgcgccgcctccggcttcaccttcacccactacgccatggactgggtccgccaggcccccggcaagggcctcgagtgggtcgccgtcatctcctccgacggctcctccaaggactacgccgactccgtcaagggccgcttcaccatctcccgcgacaactccaagaacaccctctccctccagatgaactccctccgccccgaggacaccgccgtctactactgcgccaaggacctcggcgcctccaaggacgacgagtgggccaccgactactacgacctctccatcgcctaccccgtccacgacccccgcgccgtcgtcggcggcttcgacatctggggccagggcaccatggtcaccgtctcctcc

SEQ ID NO: 17472 - RNA, 432 nt, synthetic construct
  misc_feature 1..432: note = derived and/or modified sequence opt2 from anti-HIV_cap256-048-058393_VR-Chain
  source 1..432: mol_type = other RNA
caggtccagctcgtcgagtccggcggcggcgtcgtccagcccggcggctccctccgcctctcctgcgccgcctccggcttcaccttcaacacctacggcatgcactgggtccgccaggcccccggcaagggcctcgagtgggtcaccttcatccgctacgacggctccaacgagtactacgccgactccgtcaagggccgcttcaccatctcccgcgacaactccaagaacaccctctacctccagatgaactccctctccgtcgaggacaccgccgtctactactgcgccaaggacctcggcaagaacaaggacgacgagtgggccaccgactactacgacatctccatcgcctaccccgtccccgacccccgcgccgtcgtcggcgtcttcgacatctggggccagggcaccgtcgtcaccgtctcctcc

SEQ ID NO: 17473 - RNA, 432 nt, synthetic construct
  misc_feature 1..432: note = derived and/or modified sequence opt2 from anti-HIV_cap256-048-058159_VR-Chain
  source 1..432: mol_type = other RNA
caggtccagctcgtcgagtccggcggcggcgtcgtccagcccggccgctccctccgcctctcctgcgccgcctccggcttcaccttctcctcctaccccatgcactgggtccgccaggcccccggcaagggcctcgagtgggtcgccgtcatctccttcgccggcaccaacaagtactacgcccactccgtcaagggccgcttcaccatctcccgcgacaactccaagaacaccctctacctccagatgaactccctccgcgccgaggacaccgccctctactactgcgcccgcgacctccgcgagtccgagtgcgaggagtgggcctccgactactacgacttcggccgcgagtacccctgccaggacccccgcggcgtcgtcggcaccttcgacatctggggccgcggcaccatggtcaccgtctcctcc

SEQ ID NO: 17474 - RNA, 432 nt, synthetic construct
  misc_feature 1..432: note = derived and/or modified sequence opt2 from anti-HIV_cap256-048-057127_VR-Chain
  source 1..432: mol_type = other RNA
gacgtctacctcgtcgagtccggcggcggcctcgtccagcccggcggctccctccgcctctcctgcgtcgcctccggcatcaccttctcctcctacggcatgcactgggtccgccaggcccccggcaagggcctcgagtgggccgccttcatccgctacgacggccgcaacaagtactacgccgactccgtcaagggccgcttcaccatctcccgcgacaactccaagaacaccctctccctccagatgaacaacctccgcgccgaggacaccgccgtctactactgcgccaaggaggtcggcgacaacaaggacgacgagtgggcctccgactactacgacctctccatcgcctaccccgtccaggacccccgcgccgtcgtcggcggctacgacatctggggccagggcaccatggtcaccgtctcctcc

SEQ ID NO: 17475 - RNA, 432 nt, synthetic construct
  misc_feature 1..432: note = derived and/or modified sequence opt2 from anti-HIV_cap256-048-056251_VR-Chain
  source 1..432: mol_type = other RNA
gaggtccagctcgtcgagtccggcggcggcctcgtccagcccggccgctccctccgcctctcctgcgccggctccggcttcaccttctccaacttcggcttccactgggtccgccaggcccccggcaagggcctcgagtgggtcgccgccatctccttcgccggctacaacaagtactacgccgactccgtcaagggccgcttcaccatctcccgcgagaactccaacaacatgctctacctccagatgtcctccctccgcgccgaggacaccgccgtctactactgcgccaaggacctccgcgagtccgagtgcgaggagtgggcctccgactactacgacttcggcaaggactacccctgccaggacccccgcggcgtcgtcggcaccttcgacgtctggggccacggctccctcgtcaccgtctcctcc

SEQ ID NO: 17476 - RNA, 432 nt, synthetic construct
  misc_feature 1..432: note = derived and/or modified sequence opt2 from anti-HIV_cap256-048-055421_VR-Chain
  source 1..432: mol_type = other RNA
caggtccagctcgtcgagtccggcggcggcgtcgtccagcccgcccgctccctccgcctctcctgcgccgcctccggcttcatcttctccacctacggcatgcactgggtccgccaggcccccggcaagggcctcgagtgggtcgccgtcatctcctccgacggctcctccaaggactacgccgactccgtcaagggccgcttcaccatctcccgcgacaactccaagaacaccctctccctccagatgaactccctccgccccgaggacaccgccgtctactactgcgccaaggacctcggcgcctccaaggacgacgagtgggccaccgactactacgacttctccatcgcctaccccgtccaggacccccgcgccgtcgtcggcgccttcgacatctggggccagggcaccatggtcaccgtctcctcc

SEQ ID NO: 17477 - RNA, 432 nt, synthetic construct
  misc_feature 1..432: note = derived and/or modified sequence opt2 from anti-HIV_cap256-048-054989_VR-Chain
  source 1..432: mol_type = other RNA
caggtccagctcgtcgagtccggcggcggcgtcgtccagcccggcggctccctccgcctctcctgcgccgcctccggcttcaccttctccaccaacggcatgcactgggtccgccaggcccccggcaagggcctcgagtgggtcgccttcatccgctacgacggctccaacaagtactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17478 - RNA, 435 nt, synthetic construct
  misc_feature 1..435: note = derived and/or modified sequence opt2 from anti-HIV_cap256-048-054759_VR-Chain
  source 1..435: mol_type = other RNA
caggtccagctcgtcgagtccggcggcggcgtcgtccagcccggccgctccctccgcctctcctgcgccgcctccggcttctccttctccaagaacggcatgcactgggtccgccaggcccccggcaagggcctcgagtgggtcgccttcgtcgccttcgacgagtccgacaagtactacgccgactccgtcaagggccgcttcaccatctcccgcgacaactccaagaacaccctctccctccagatgaactccctccgcgtcgaggacaccgccgtctactactgcgccaaggaggtcggcgagaacaaggacgacgagtgggccgcccccgactactacgacttctccatcgcctaccccgtccaggacccccgcgccgtcgtcggcggcttcgacatctggggccagggcaccatggtcaccgtctcctcc

SEQ ID NO: 17479 - RNA, 432 nt, synthetic construct
  misc_feature 1..432: note = derived and/or modified sequence opt2 from anti-HIV_cap256-048-052573_VR-Chain
  source 1..432: mol_type = other RNA
caggtcaagctcgtcgagtccggcggcggcgtcgtccagcccggccgctccctccgcctctcctgcgccgcctccggcttctccttctccaactacgccatggactgggtccgccaggcccccggcaagggcctcgagtgggtcgccgtcgtctcctccgacggctccaacaagaactacgccgactccgtcaagggccgcttcaccatctcccgcgacaactccaagaacaccgtctacctccagatgaactccctccgcgccgaggacaccgccgtctactactgcgccaaggacctcggcgccaacaaggacgacgagtgggccaccgactactacgactggtccatcgcctaccccgtccacgacccccgcgccgtcgtcggcgtcttcgacatctggggccagggcaccctcgtcaccgtctcctcc

SEQ ID NO: 17480 - RNA, 432 nt, synthetic construct
  misc_feature 1..432: note = derived and/or modified sequence opt2 from anti-HIV_cap256-048-051477_VR-Chain
  source 1..432: mol_type = other RNA
caggagcagctcgtcgagtccggcggcggcgtcgtccagcccggccgctccctccgcctctcctgcgccgcctccggcttcaccttctccaactacgccatgcactgggtccgccaggcccccggcaagggcctcgagtgggtcgccgccatgtcccacgacggctccgacaagtactacgccgactccgtcaagggccgcttcaccatctcccgcgacaactccaagaacaccctctacatgcagatgaactccctccgcgccgaggacaccgccgtctactactgcgccaaggaccagggcgagtccgagaaggaggagtgggcctccgactactacgacctctccatcgcctaccccatccaggacccccgcgccatggtcggcgccttcgacatctggggccagggcaccatggtcaccgtctcctcc

SEQ ID NO: 17481 - RNA, 432 nt, synthetic construct
  misc_feature 1..432: note = derived and/or modified sequence opt2 from anti-HIV_cap256-048-051299_VR-Chain
  source 1..432: mol_type = other RNA
caggtccagctcgtcgagtccggcggcggcgtcgtccagcccggccgctccctccgcctctcctgcgccgcctccggcttcaccttctccaccttcggcatgcactgggtccgccaggcccccggcaagggcctcgagtgggtcgccctcatctcccacgacggcaacaacaagtactacgccgactccctcaagggccgcttcaccatctcccgcgagaactccaagaacaccctcttcctccagatgaactccctccgcgccgaggacacctccgtctactactgcgccaaggacctcggcgactccgagtgcgaggagtgggcctccgactactacgacttcggcaaggactacccctgcctccacccccgcggcgtcgtcggcaccttcgacttctggggccacggcaccatggtcaccgtctcctcc

SEQ ID NO: 17482 - RNA, 432 nt, synthetic construct
  misc_feature 1..432: note = derived and/or modified sequence opt2 from anti-HIV_cap256-048-050815_VR-Chain
  source 1..432: mol_type = other RNA
caggtccagctcgtcgagtccggcggcggcgtcgtccagcccggcggctccctccgcctctcctgcgtcgtctccggcttcaccttctcctcctacggcatgcactgggtccgccaggcccccggcaagggcctcgagtgggtctccttcatccgcttcgacggcaactacgagtactacgtcgactccgtcaagggccgcttcaccatctcccgcgacaactccaagaacaccgtctacctccagatggactccctccgcgccgaggacaccgccgtctactactgcgccaaggacgtcggcgactacaaggacgacgagtgggccaccgactactacgacttctccatcgcctaccccgtccccgacccccgcgccgtcgtcggcgccttcgacttctggggccagggcaccatggtcaccgtctcctcc

SEQ ID NO: 17483 - RNA, 432 nt, synthetic construct
  misc_feature 1..432: note = derived and/or modified sequence opt2 from anti-HIV_cap256-048-049884_VR-Chain
  source 1..432: mol_type = other RNA
caggtccagctcgtcgagtccggcggcggcgtcgtccagcccggccgctccctccgcctctcctgcgccgcctccggcttctccttcaacacctacgccatgcactgggtccgccaggcccccggcaagggcctcgagtggatggccctcatctcctacgacggctccaacaagtactacgtcgactccgtcaagggccgcttcaccatctcccgcgacaactccaagaacaccctctacctccagatgaactccctccgcgccgaggacaccgccgtctactactgcgccaaggacctcggcggcaacaaggacgacgagtgggccaccgactactacgacctctccatcgcctaccccgtccaggacccccgcgtcgtcgtcggcatcttcgacatctggggccagggcaccatggtcaccgtctcctcc

SEQ ID NO: 17484 - RNA, 432 nt, synthetic construct
  misc_feature 1..432: note = derived and/or modified sequence opt2 from anti-HIV_cap256-048-049170_VR-Chain
  source 1..432: mol_type = other RNA
caggtccagctcgtcgagtccggcggcggcgtcgtccagcccggccgctccctccgcctctcctgcgccgcctccggcttcatcttctcctcctacggcatgcactgggtccgccaggcccccggcaagggcctcgagtgggtcgccgtcatctccggcgacggcaccaagaaggacttcgccgactccgtcaagggccgcttcaccatctccaaggacaactccaagaacatggtctccctccagatgaactccctccgcgccgaggacgccgccgtctactactgcgccaaggacctcggcgagtccgacaacgaggagtggccctccgactactacgacttcggccgcgacttcaccggccagaacccccgcgccgtcgtcggcaccttcgacctctggggccagggcaccatggtcaccgtctcctcc

SEQ ID NO: 17485 - RNA, 435 nt, synthetic construct
  misc_feature 1..435: note = derived and/or modified sequence opt2 from anti-HIV_cap256-048-048531_VR-Chain
  source 1..435: mol_type = other RNA
caggtccagctcgtcgagtccggcggcggcgtcgtccagcccggccgctccctccgcctctcctgcgccgcctccggcttcaccttctcctcctacggcctccactgggtccgccaggcccccggcaagggcctcgagtgggtcgccttcatctcctacgacggcaacaacaagcactacgtcgactccgtcaagggccgcttcaccatctcccgcgacaactccaagaacaccctctacctccagatgaactccctccgcgccgaggacaccgccgtctactactgcgccaaggacctcggcggcgagtccgagatcgaggagtgggccaccgactactacgacttctccatcgcctaccccgtcaaggagtcccgcggcgtcgtcggcatcttcgacatgtggggccagggcaccatggtcaccgtctcctcc

SEQ ID NO: 17486 - RNA, 432 nt, synthetic construct
  misc_feature 1..432: note = derived and/or modified sequence opt2 from anti-HIV_cap256-048-048259_VR-Chain
  source 1..432: mol_type = other RNA
caggtccagctcgtcgagtccggcggcggcgtcgtccagcccggccgctccctccgcctctcctgcgccgcctccggcttcaccttctccacctgcgccatgcactgggtccgccaggcccccggcaagggcctcgagtgggtcgccgtcatctcctacgacggctccaacaagtactacgtcgactccgtcaagggccgcttcaccatctcccgcgacaactccaagaacaccctctacctccagatgaactccctccgcgccgaggacaccgccgtctactactgcgccaaggaggtcgacatcaacaaggaggacgagtgggcctccgactactacgacttctccatcgcctaccccgtccaggacccccgcgccgtcgtcggcggcttcgacatctggggccagggcaccatggtcaccgtctcctcc

SEQ ID NO: 17487 - RNA, 432 nt, synthetic construct
  misc_feature 1..432: note = derived and/or modified sequence opt2 from anti-HIV_cap256-048-047313_VR-Chain
  source 1..432: mol_type = other RNA
caggtccagctcgtcgagtccggcggcggcgtcgtccagcccggccgctccctccgcctctcctgcgccgcctccggcttcaccttctccaccttcggcatgcactgggtccgccaggcccccggcaagggcctcgagtgggtcgccgtcatctcccacgacggcaacaacaagtactacgccgactccgtcaagggccgcttcaccatctcccgcgacaactccaagaacaccgtctacctccagatgaactccctccgcgccgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17488 - RNA, 432 nt, synthetic construct
  misc_feature 1..432: note = derived and/or modified sequence opt2 from anti-HIV_cap256-048-046596_VR-Chain
  source 1..432: mol_type = other RNA
caggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcatgcgcttcgacggctccaaccgctactacggcgactccgtcaagggccgcttcaccatctcccgcgacaactccaagaacaccctctacctccagatgaactccctccgcaccgaggacgccgccctctactactgcgccaaggacatgcgcgagttcgagtgcgaggagtgggcctccgactactacgacttcggccgcgactacccctgccaggacccccgcggcgtcgtcggcatcttcgacatctggggccagggcaccatggtcaccgtctcctcc

SEQ ID NO: 17489 - RNA, 432 nt, synthetic construct
  misc_feature 1..432: note = derived and/or modified sequence opt2 from anti-HIV_cap256-048-044781_VR-Chain
  source 1..432: mol_type = other RNA
caggtccagctcgtcgagtccggcggcggcgtcgtccagcccggccgctccctccgcctctcctgcgccgcctccggcttcaccttcacctcctacgccatccactgggtccgccaggcccccggcaagggcctcgagtgggtcgccgtcatctcctacgacggctccaagaagaactacgccgactccgtcaagggccgcttcaccatctcccgcgacaactccaagaacaccctctacgtccagatgaactccctccgcgccgaggacaccgccgtctactactgcgccaaggaggtcggcgaggacaaggacgacgagtgggcctccgactactacgacctctccatcgcctaccccgtccacgacccccgcgccgtcgtcggcggcttcgacatctggggccagggcaccatggtcaccgtctcctcc

SEQ ID NO: 17490 - RNA, 432 nt, synthetic construct
  misc_feature 1..432: note = derived and/or modified sequence opt2 from anti-HIV_cap256-048-042599_VR-Chain
  source 1..432: mol_type = other RNA
caggtccagctcgtcgagtccggcggcggcgtcgtccagcccggccgctccctccgcctctcctgcgccgcctccggcttcaccttctccaactacggcatgcactgggtccgccagacccccggcaagggcctcgagtgggtcgccgtcatctcctacgacggctccaacaagttctacgccgactccgtcaagggccgcttcaccatctcccgcgacaactccaagaacaccctctacctccagatgtcctccctccgcgccgacgacaccgccgtctactactgcgccaaggaggtcggcgaggacaaggacgacgagtgggcctccgactactacgacctctccatcgcctaccccgtccacgacccccgcgccgtcgtcggcggcttcgacatctggggccagggcaccatggtcaccgtctcctcc

SEQ ID NO: 17491 - RNA, 432 nt, synthetic construct
  misc_feature 1..432: note = derived and/or modified sequence opt2 from anti-HIV_cap256-048-041276_VR-Chain
  source 1..432: mol_type = other RNA
caggtccagctcgtcgagtccggcggcggcgtcgtccagcccggccgctccctccgcctctcctgcgccgcctcccgcttcaccttctcctcctacgccatgcactgggtccgccaggcccccggcaagggcctcgagtgggtcgccatcatctcctacgacggctccaacaagtactacgccgactccgtcaagggccgcttcaccatctcccgcgacaactccaagaacaccctcttcctccagatgaactccctccgcgccgaggacaccgccctctactactgcgccaaggacctcggcggctacaagtccgacgagtgggccaccgactactacgacctctccatcgcctaccccatccaggacccccgcgccgtcgtcggcgccttcgacatctggggccagggcaccatggtcaccgtctcctcc

SEQ ID NO: 17492 - RNA, 432 nt, synthetic construct
  misc_feature 1..432: note = derived and/or modified sequence opt2 from anti-HIV_cap256-048-040200_VR-Chain
  source 1..432: mol_type = other RNA
caggtccagctcgtcgagtccggcggcggcgtcgtccagcccggccgctccctccgcctctcctgcgtcgcctccggcttcaccttctcctccttcggcatgcactgggtccgccaggcccccggcaagggcctcgagtgggtcgccgtcatctcccacgacggccacaacaagtactacgccgactccctcaagggccgcttcaccgtctcccgcgagaactccaagaacaccctcttcctccagatgaactccctccgcgccgaggacacctccgtctactactgcgccaaggacctcggcggcggcgagtgcgaggagtgggcctccgactactacgacttcggccgcgactacccctgcctcaccccccgcggcgtcgtcggcaccttcgacatctggggccacggcaccaccgtcaccgtctcctcc

SEQ ID NO: 17493 - RNA, 432 nt, synthetic construct
  misc_feature 1..432: note = derived and/or modified sequence opt2 from anti-HIV_cap256-048-039061_VR-Chain
  source 1..432: mol_type = other RNA
gaggtccagctcctcggctccggcggcggcctcgtccagcccggcggctccctccgcctcacctgcgccgtctccggcttcaccttctcctccttcgccatgtcctgggtccgccaggcccccggcaagggcctcgagtgggtcgccctcatctcctacgacggcaccgacaagtactacgccgactccgtcaagggccgcttcaccatctcccgcgacaactccaagaacaccctctacctccagatgaactccctccgcgtcgaggacaccgccatctaccactgcgccaaggacctcggcggcaccaagtccgacgagtgggccaccgactactacgacctctccatcgcctaccccatccaggaccccggcgccgtcgtcggcgtcttcgacatctggggccagggcaccatggtcaccgtctcctcc

SEQ ID NO: 17494 - RNA, 432 nt, synthetic construct
  misc_feature 1..432: note = derived and/or modified sequence opt2 from anti-HIV_cap256-048-038515_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgtcgtcatctcctacgacggctccaacaagtactacgccgactccgtcaagggccgcttcaccatctcccgcgacaactccaagaacaccctcttcctccagatgaactccctccgcgccgaggacaccgccctctactactgcgccaaggacgtcggcgagtacaagtccgacgagtgggccaccgactactacgacctctccatcgcctaccccatccaggacccccgcgccatggtcggcgccttcgacatctggggccagggcaccatggtcaccgtctcctcc

SEQ ID NO: 17495 - RNA, 432 nt, synthetic construct
  misc_feature 1..432: note = derived and/or modified sequence opt2 from anti-HIV_cap256-048-038255_VR-Chain
  source 1..432: mol_type = other RNA
caggtccagctcgtcgagtccggcggcggcgtcgtccagcccggccgctccctccgcctctcctgcgccgcctccggcttcaccctctcctcctacgccatgcactgggtccgccaggcccccggcaagggcctcgagtgggtcgccgtcatctcctacgacggctccaacaagtactacgccgactccgtcaagggccgcttcaccatctcccgcgacaactccaagaacgccctctacctccagatgaactccctccgcgccgaggacaccgccctctactactgcgccaaggacctccgcgagtacgagtgcgaggagtgggcctccgactactacgacttcggccgcgactacccctgccaggacccccgcggcgtcgtcggcaccttcgacatctggggccagggcaccatggtcaccgtctcctcc

SEQ ID NO: 17496 - RNA, 432 nt, synthetic construct
  misc_feature 1..432: note = derived and/or modified sequence opt2 from anti-HIV_cap256-048-038177_VR-Chain
  source 1..432: mol_type = other RNA
caggtccagctcgtcgagtccggcggcggcgtcgtccagcccggccgctccctccgcctctcctgcgccgcctccggcttcaccttcaacacctacggcatccactgggtccgccaggcccccggcaagggcctcgagtgggtcgccctcatctcctacgacggcaccgacaagtactacgccgactccgtcaagggccgcttcaccatctcccgcgacaactccaagaacaccctctacctccagatgaactccctccgcgtcgaggacaccgccatctaccactgcgccaaggacctcggcggcaccaagtccgacgagtgggccaccgactactacgacctctccatcgcctaccccatccaggaccccggcgccgtcgtcggcgtcttcgacatctggggccagggcaccatggtcaccgtctcctcc

SEQ ID NO: 17497 - RNA, 432 nt, synthetic construct
  misc_feature 1..432: note = derived and/or modified sequence opt2 from anti-HIV_cap256-048-035513_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatggcctgggtccgccaggcccccggcaagggcctcgagtgggtcaccgtcatctccttcgccggcgtcaagaagtactacgccgactccgtcaagggccgcttcaccatctcccgcgacaactccaagggcaccctctacctccagatggacggcctccgccccgaggacaccgccctctactactgcgccaaggacctcggcgagcgcgagtgcgaggagtgggcctccgactactacgacttcggccgcgacttcccctgccaggacccccgcggcgtcgtcggcaccttcgacatctggggccagggcaccatggtcaccgtctcctcc

SEQ ID NO: 17498 - RNA, 432 nt, synthetic construct
  misc_feature 1..432: note = derived and/or modified sequence opt2 from anti-HIV_cap256-048-034112_VR-Chain
  source 1..432: mol_type = other RNA
cagatgcagctcgtcgagtccggcggcggcgtcgtccagcccggccgctccctccgcctctcctgcgccgcctccggcttcaccttcaactcctacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17499 - RNA, 432 nt, synthetic construct
  misc_feature 1..432: note = derived and/or modified sequence opt2 from anti-HIV_cap256-048-033983_VR-Chain
  source 1..432: mol_type = other RNA
caggtccagctcgtcgagtccggcggcggcgtcgtccagcccggcgagtccctccgcctctcctgcgccgcctccggcttcaccctctcctcccacggcatccactgggtccgccaggcccccggcaagggcctcgagtgggtcgccttcatctcctccgacggctccaacaagaactacggcgactccgtcaagggccgcttcaccatctcccgcgacaactccaagaacaccctcttcctccagatgaactccctccgcgccgaggacaccgccctctactactgcgccaaggacgtcggcgagtacaagtccgacgagtgggccaccgactactacgacctctccatcgcctaccccatccaggacccccgcgccatggtcggcgccttcgacatctggggccagggcaccatggtcaccgtctcctcc

SEQ ID NO: 17500 - RNA, 432 nt, synthetic construct
  misc_feature 1..432: note = derived and/or modified sequence opt2 from anti-HIV_cap256-048-032688_VR-Chain
  source 1..432: mol_type = other RNA
caggtccagctcgtcgagtccggcggcggcgtcgtccagcccggccgctccctccgcctctcctgcgccgcctccggcttcatcttcaactcctacggcatgcactgggtccgccaggcccccggcaagggcctcgagtgggtcgccgtcgtccacggcgacggcggcaacaagtactacgccgactccgtcaagggccgcttcaccatctcccgcgacaactccaagaacaccctctacctcgagatgaactccctccgcgccgaggacaccgccgagtactactgcgccaaggacctcggcgagtccgacaaggaggagtggccctccgactactacgacttcggccgcgacttcaccggccaggtcccccgcgccgtcgtcggcgccttcgacatctggggccagggcaccatggtcaccgtctcctcc

SEQ ID NO: 17501 - RNA, 432 nt, synthetic construct
  misc_feature 1..432: note = derived and/or modified sequence opt2 from anti-HIV_cap256-048-031092_VR-Chain
  source 1..432: mol_type = other RNA
caggtccagctcgtcgagtccggcggcggcgtcgtccagcccggccgctccctccgcctctcctgcgccgcctccggcttctccttctacaacttcgccatggactgggtccgccaggcccccggcaagggcctcgagtgggtcgccgtcatctcctccgacggcggcaacaagaactacgtcgactccgtcaagggccgcttcaccatctcccgcgacaactccaagaacaccctctacctccagatgaactccctccgcgccgaggacaccgccgtctactactgcgccaaggacctcggcggcaccaaggacgacgagtgggccaccgactactacgacatctccatcgcctaccccgtccaggacccccgcgccgtcgccggcgccttcgacatctggggccagggcaccatggtcaccgtctcctcc

SEQ ID NO: 17502 - RNA, 435 nt, synthetic construct
  misc_feature 1..435: note = derived and/or modified sequence opt2 from anti-HIV_cap256-048-030464_VR-Chain
  source 1..435: mol_type = other RNA
caggtccagctcgtcgagtccggcggcggcctcgtcaagcccggcggctccctccgcctctcctgcgaggcctccggcttctccttcaccaactactacatgtcctggatccgccaggcccccggcaagggcctcgagtgggtcgccgtcatctccttcaacggccgcaacaagtactacgccgacttcgtcaagggccgcttcaccatctcccgcgacaactccaagaacaccctctccctccagatgaactccctccgcgtcgaggacaccgccgtctactactgcgccaaggaggtcggcgagaacaaggacgacgagtgggccgcccccgactactacgacttctccatcgcctaccccgtccaggacccccgcgccgtcgtcggcggcttcgacatctggggccagggcaccatggtcaccgtctcctcc

SEQ ID NO: 17503 - RNA, 432 nt, synthetic construct
  misc_feature 1..432: note = derived and/or modified sequence opt2 from anti-HIV_cap256-048-030289_VR-Chain
  source 1..432: mol_type = other RNA
caggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcatccgctacgacggctccaacaagtactacgccgactccgtcaagggccgcttcaccatctcccgcgacaactccaagaacaccgtctacctccagatgaactccctccgcgtcgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17504 - RNA, 432 nt, synthetic construct
  misc_feature 1..432: note = derived and/or modified sequence opt2 from anti-HIV_cap256-048-030261_VR-Chain
  source 1..432: mol_type = other RNA
caggtccagctcgtcgagtccggcggcggcgtcgtccagcccggcggctccctccgcctctcctgcgccgcctccggcttcaccttctccaccttcggcatgcactgggtccgccaggcccccggcaagggcctcgagtgggtcgccgtcatctcccacgacggctccaacaagtactacgccgactccctcaagggccgcttcaccatctcccgcgagaactccaagaacaccctctacctccagatgaactccctccgcctcgaggacaccgccgtctaccactgcgccaaggacctcggcggctccaagtccgacgagtgggccaccgactactacgacctctccgtcgcctaccccgtccaggacccccgcgccgtcgtcggcgtcttcgacatctggggccagggcaccatggtcaccgtctcctcc

SEQ ID NO: 17505 - RNA, 432 nt, synthetic construct
  misc_feature 1..432: note = derived and/or modified sequence opt2 from anti-HIV_cap256-048-029362_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccggcatctccttcgccggcaccaacaagtactacgccgactccgtcaagggccgcttcaccatctcccgcgacaactccaagaacaccctctacctccagatgaactccctccgcaccgaggacgccgccctctactactgcgccaaggacatgcgcgagttcgagtgcgaggagtgggcctccgactactacgacttcggccgcgactacccctgccaggacccccgcggcgtcgtcggcatcttcgacatctggggccagggcaccatggtcaccgtctcctcc

SEQ ID NO: 17506 - RNA, 432 nt, synthetic construct
  misc_feature 1..432: note = derived and/or modified sequence opt2 from anti-HIV_cap256-048-027638_VR-Chain
  source 1..432: mol_type = other RNA
caggtccagctcgtcgagtccggcggcggcgtcgtccagcccggccgctccctccgcctctcctgcgtcgcctccggcttcatcttctcctcctacggcatccactgggtccgccaggcccccggcaagggcctcgagtgggtcgccgtcatctccggcgacggcaccaacaagtactgcgccgactccgtcaagggccgcttcaccatctcccgcgacaactccaagaacaccgtcttcctccagatgaactccctccgcgccgaggacaccgccgtcttctactgcgccaaggacctcggcgagtccgacaaggaggagtggccctccgactactacgacttcggccgcgacttcaccggccaggtcccccgcgccgtcgtcggcgccttcgacatctggggccagggcaccatggtcaccgtctcctcc

SEQ ID NO: 17507 - RNA, 432 nt, synthetic construct
  misc_feature 1..432: note = derived and/or modified sequence opt2 from anti-HIV_cap256-048-027613_VR-Chain
  source 1..432: mol_type = other RNA
gtccagcagctcgtcgagtccggcggcgacgtcgtccagcccggcacctccctccgcctctcctgcgaggcctccggcctcatcctctccggctacggcctccactgggtccgccaggcccccggcaagggcatggagtgggtcgccgtcatctcctacgacggctccaacaagtactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccaccgcctaccccgtcgagcacccccgcgccgtcgtcggcgtcttcgacatctggggccagggcaccaaggtcaccgtctcctcc

SEQ ID NO: 17508 - RNA, 432 nt, synthetic construct
  misc_feature 1..432: note = derived and/or modified sequence opt2 from anti-HIV_cap256-048-026627_VR-Chain
  source 1..432: mol_type = other RNA
caggtccagctcctcggctccggcggcggctccgtccagcccggcggctccctccgcctcacctgcgccgtctccggcttcaccttctcctccttcgccatgtcctgggtccgccaggcccccggcaagggcctcgagtgggtcgccttcatctcctccgacggcaccaacaagaactacggcgactccgtcaagggccgcttcaccatctcccgcgacaactccaagaacaccctcttcctccagatgaactccctccgcgccgaggacaccgccctctactactgcgccaaggacctcggcggctacaagtccgacgagtgggccaccgactactacgacctctccatcgcctaccccatccaggacccccgcgccgtcgtcggcgccttcgacatctggggccagggcaccatggtcaccgtctcctcc

SEQ ID NO: 17509 - RNA, 432 nt, synthetic construct
  misc_feature 1..432: note = derived and/or modified sequence opt2 from anti-HIV_cap256-048-026239_VR-Chain
  source 1..432: mol_type = other RNA
cagatgcagctcgtcgagtccggcggcggcgtcgtccagcccggccgctccctccgcctctcctgcgccgcctccggcttcaccttcaactcctacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcaccgaggacgccgccctctactactgcgccaaggacatgcgcgagttcgagtgcgaggagtgggcctccgactactacgacttcggccgcgactacccctgccaggacccccgcggcgtcgtcggcatcttcgacatctggggccagggcaccatggtcaccgtctcctcc

SEQ ID NO: 17510 - RNA, 432 nt, synthetic construct
  misc_feature 1..432: note = derived and/or modified sequence opt2 from anti-HIV_cap256-048-025518_VR-Chain
  source 1..432: mol_type = other RNA
caggtccagctcgtcgagtccggcggcggcgtcgtccagcccggccgctccctccgcctctcctgcgccgtctccggcttcaccttctcccagcacgccatgcactgggtccgccaggcccccggcaagggcctcgagtgggtcaccctcatctccaacgacggcaccgagaagttctacgccgactccgtcaagggccgcttcaccatctcccgcgacaactccaagaacaccctctacctccagatgaactccctctccgtcgaggacaccgccgtctactactgcgccaaggacctcggcaagaacaaggacgacgagtgggccaccgactactacgacatctccatcgcctaccccgtccccgacccccgcgccgtcgtcggcgtcttcgacatctggggccagggcaccgtcgtcaccgtctcctcc

SEQ ID NO: 17511 - RNA, 432 nt, synthetic construct
  misc_feature 1..432: note = derived and/or modified sequence opt2 from anti-HIV_cap256-048-024854_VR-Chain
  source 1..432: mol_type = other RNA
caggtccagctcgtcgagtccggcggcggcgtcgtccagcccggccgctccctcaccctctcctgcgccgcctccggcttcaccttcaacaactacgacatgcactgggtccgccaggcccccggcaagggcctcgagtgggtcgccttcacccgctacgacggctccaaccagtactacgccgactccgtcaccggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17512 - RNA, 432 nt, synthetic construct
  misc_feature 1..432: note = derived and/or modified sequence opt2 from anti-HIV_cap256-048-024537_VR-Chain
  source 1..432: mol_type = other RNA
caggtccagctcgtcgagtccggcggcgccgtcgtccagcccggccgctccctccgcctctcctgcgtcgcctccggcttcaccttctcctcctacgccatgcactgggtccgccaggcccccggcaagggcctcgactgggtcgccctcatctcctacgacggctccaacaagtacttcgccgactccgtcaagggccgcttcgccatctcccgcgacaactccaagaacaccctctacctccagatgaactccctccgccccgaggacaccgccgtctactactgcgccaaggacctcggcggcggcgagtgcgagacctgggcctccgactactacgacttcggcaaggactacccctgcctcgacccccgcgacgtcgtcggcaccttcgacatctgggtccagggcaccctcgtcaccgtctcctcc

SEQ ID NO: 17513 - RNA, 432 nt, synthetic construct
  misc_feature 1..432: note = derived and/or modified sequence opt2 from anti-HIV_cap256-048-021781_VR-Chain
  source 1..432: mol_type = other RNA
caggtccacctcgtcgagtccggcggcggcctcgtcaagcccggcggctccctccgcctctcctgcgaggcctccggcttctccttctccaactacgccatggactgggtccgccaggcccccggcaagggcctcgagtgggtcgccttcgtctcctccgacggctccaacaagaactacgccgactccgtcaagggccgcttcaccatctcccgcgacaactccaagaacaccgtctacctccagatgaactccctccgcgtcgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17514 - RNA, 432 nt, synthetic construct
  misc_feature 1..432: note = derived and/or modified sequence opt2 from anti-HIV_cap256-048-021758_VR-Chain
  source 1..432: mol_type = other RNA
caggtccagctcgtcgagtccggcggcggcgtcgtccagcccggccgctccctccgcctctcctgcgccgcctccggcttcaccttctcccgctacggcatgcactgggtccgccaggcccccggcaagggcctcgagtgggtcgccgtcatctcctacgacggctccaaggagtactacgccgactccgtcaagggccgcttcaccatctcccgcgacaactccaaggacaccctctacctccagatgtcctccctccgcgtcgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17515 - RNA, 432 nt, synthetic construct
  misc_feature 1..432: note = derived and/or modified sequence opt2 from anti-HIV_cap256-048-020988_VR-Chain
  source 1..432: mol_type = other RNA
caggtccagctcgtcgagtccggcggcggcgtcgtccagcccggccgctccctccgcctctcctgcgaggcctccgccttcaccttctcctcctacggcatgcactgggtccgccaggcccccggcaagggcctcgagtgggtcaccttcatctcctactccggcaacaacaagtactacgccgactccgtcaagggccgcttcaccgtctcccgcgacaactccaagaacaccctctacctccagatgaactccctcacctccgaggacaccgccgtctactactgcgccaaggacctcggcggctccaagaccgacgagtggggcaccgactactacgagttctggaacgcctaccccgtccaggacccccgcgtcgtcgtcggcgccttcgacatctggggccacggcaccatggtcaccgtctcctcc

SEQ ID NO: 17516 - RNA, 435 nt, synthetic construct
  misc_feature 1..435: note = derived and/or modified sequence opt2 from anti-HIV_cap256-048-020663_VR-Chain
  source 1..435: mol_type = other RNA
caggtccagctcgtcgagtccggcggcggcgtcgtccagcccggcatgtccctccgcctctcctgcgccgcctccggcttcaccttctccaacttcggcatgcactgggtccgccaggcccccggcaagggcctcgagtgggtcgccgtcatctcccacgacggcaacaacaagtactaccccgactccgtccagggccgcttcaccatctcccgcgagaactccaagaacaccctctacctccagatgaactccctcaagcccgaggacaccgccgtctacttctgcgccaaggacctcggcggcgagtccgaggtcgaggagtgggcctccgactactacgacttcggccgcgacatccccggccccgacccccgcggcgtcgtcggcaccctcgacatctggggccacggcaccatggtcaccgtctcctcc

SEQ ID NO: 17517 - RNA, 432 nt, synthetic construct
  misc_feature 1..432: note = derived and/or modified sequence opt2 from anti-HIV_cap256-048-020590_VR-Chain
  source 1..432: mol_type = other RNA
caggtccagctcgtcgagtccggcggcggcgtcgtccagcccggcggcgtcccccgcctcgcctgcgccgcctccggcttcaccttctcctcctacgccatgcactgggtccgccaggcccccggcaagggcctcgagtgggtcaccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcggcaccaaggacgacgagtgggccaccgactactacgacatctccatcgcctaccccgtccaggacccccgcgccgtcgccggcgccttcgacatctggggccagggcaccatggtcaccgtctcctcc

SEQ ID NO: 17518 - RNA, 432 nt, synthetic construct
  misc_feature 1..432: note = derived and/or modified sequence opt2 from anti-HIV_cap256-048-019765_VR-Chain
  source 1..432: mol_type = other RNA
caggtccagctcgtcgagtccggcggcggcgtcgtccagcccggccgctccctccgcctctcctgcgccgcctccggcttcatcttcaccaactacgccatggactgggtccgccaggcccccggcaagggcctcgagtgggtcgccgtcatctcctccgacggctccaacaagaactacgccgactccgtcaagggccgcttcaccatctcccgcgacaactccaagaacaccgtctccctccagatgaactccctccgcgccgaggacaccgccgtctactactgcgccaaggacctcggcgactccaagaaggacgagtgggccaccgactactacgacctctccatcgcctaccccgtccccgacccccgcgccgtcgtcggcgccttcgacatctggggccagggcaccatggtcaccgtctcctcc

SEQ ID NO: 17519 - RNA, 432 nt, synthetic construct
  misc_feature 1..432: note = derived and/or modified sequence opt2 from anti-HIV_cap256-048-019254_VR-Chain
  source 1..432: mol_type = other RNA
caggtccagctcgtcgagtccggcggcggcgtcgtccagcccggccgctccctccgcctctcctgcgccgcctccggcttcacctcctccacctacgccatgcactgggtccgccaggcccccggcaagggcctcgagtgggtcgccctcatctcctacgacggcaccgacaagtactacgccgactccgtcaagggccgcttcaccatctcccgcgacaactccaagaacaccctctacctccagatgaactccctccgcgtcgaggacaccgccgtctaccactgcgccaaggacctcggcggcaacaagcccgacgagtgggccaccgactactacgacctctccatcgcctaccccgtccaggacccccgcgccgtcgtcggcgtcttcgacatctggggccagggcaccatcatcaccgtctcctcc

SEQ ID NO: 17520 - RNA, 432 nt, synthetic construct
  misc_feature 1..432: note = derived and/or modified sequence opt2 from anti-HIV_cap256-048-018073_VR-Chain
  source 1..432: mol_type = other RNA
caggtccagctcgtcgagtccggcggcggcgtcgtccagcccggccgctccctccgcctctcctgcgccgcctccggcttctccctctcctcctacgccatggactgggtccgccaggcccccggcaagggcctcgagtgggtcgccgtcatctcctccgacggcaccaacaagtactacgccgactccgtcaagggccgcttcaccatcacccgcgacaactccaagaacaccctctacctccagatgaactccctccgcgtcgaggacaccgccctctactactgcgccaaggacatgggcgagtccgagaaggaggagtgggcctccgactactacgacttcggccgcgacatccccggccaggacccccgcggcgaggtcggctccttcgacatctggggccagggcaccatggtcaccgtctcctcc

SEQ ID NO: 17521 - RNA, 432 nt, synthetic construct
  misc_feature 1..432: note = derived and/or modified sequence opt2 from anti-HIV_cap256-048-016775_VR-Chain
  source 1..432: mol_type = other RNA
gaggtccagctcgtcgagttcggcggcggcctcgtccagcccggccgctccctccgcctctcctgcgccgcctccgccttcaccttctcccactacggcatccactgggtccgccaggcccccggcaagggcctcgagtgggtcgccgtcatctcccacgacggctccaccaaggactacgccgactccgtcaagggccgcttcaccatctcccgcgacaactccaagaacaccatgtacctccagatgaactccctccgcgccgaggacaccgccgtctactactgcgcccgcgacctcggcgagtccgagaccgaggagtgggccaccgactactacgacttctccatcgcctaccccgtccagaacccccgcggcgtcatcggcgtcctcgacatctggggcctcggcaccatggtcaccgtctcctcc

SEQ ID NO: 17522 - RNA, 432 nt, synthetic construct
  misc_feature 1..432: note = derived and/or modified sequence opt2 from anti-HIV_cap256-048-016069_VR-Chain
  source 1..432: mol_type = other RNA
caggtccagctcgtcgagtccggcggcggcgtcgtccagcccggccgctccctccgcctctcctgcgccgcctccggcttcaccttctccaagtacgccatgcactgggtccgccaggcccccggcaagggcctcgagtgggtcgccttcgtcgccttcgacgagtccgccaagttctacgccgactccgtcaagggccgcttcaccatctcccgcgacaactccaagaacaccctctccctccagatgaactccctccgcgccgaggacaccgccgtctactactgcgccaaggaggtcggcgagaacaaggacgacgagtgggcctccgactactacgacctctccatcgcctaccccgtccacgacccccgcgccgtcgtcggcggcttcgacgtctggggccagggcaccatggtcaccgtctcctcc

SEQ ID NO: 17523 - RNA, 432 nt, synthetic construct
  misc_feature 1..432: note = derived and/or modified sequence opt2 from anti-HIV_cap256-048-015867_VR-Chain
  source 1..432: mol_type = other RNA
caggtccagctcgtcgagtccggcggcggcgtcgtccagcccggccgctccctccgcctctcctgctccgcctccggcttctccttcaccaactacgccatggactgggtccgccaggcccccggcaagggcctcgagtgggtcgccgtcatctcctccgacggctccaacaagaactacgccgactccgtcaagggccgcttcaccatctcccgcgacaactccaagaacaccctcttcctccagatgaactccctccgccccgaggacaccgccgtctacttctgcgccaaggacctcggcgccaacaaggacgacgagtgggccaccgactactacgacctctccatcgcctaccccgtccacgacccccgcgccgtcgtcggcatcttcgacctctggggccagggcaccatggtcaccgtctcctcc

SEQ ID NO: 17524 - RNA, 432 nt, synthetic construct
  misc_feature 1..432: note = derived and/or modified sequence opt2 from anti-HIV_cap256-048-015673_VR-Chain
  source 1..432: mol_type = other RNA
caggtccacctcgtcgagtccggcggcggcgtcgtccagcccggccgctccctccgcctctcctgcgccgcctccggcttcaccttctccaacttcgccatgggctgggtccgccaggcccccggcaagggcctcgagtgggtcgccttcatctcctccgacggcaccaacaagaactacggcgactccgtcaagggccgcttcaccatctcccgcgacaactccaagaacaccctcttcctccagatgaactccctccgcgccgaggacaccgccctctactactgcgccaaggacctcggcggctacaagtccgacgagtgggccaccgactactacgacctctccatcgcctaccccatccaggacccccgcgccgtcgtcggcgccttcgacatctggggccagggcaccatggtcaccgtctcctcc

SEQ ID NO: 17525 - RNA, 432 nt, synthetic construct
  misc_feature 1..432: note = derived and/or modified sequence opt2 from anti-HIV_cap256-048-015156_VR-Chain
  source 1..432: mol_type = other RNA
caggtccagctcgtcgagtccggcggcggcgtcgtccagcccggccgctccctccgcctctcctgcgccgcctccggcttcaccttctccgtctacgccctccactgggtccgccagacccccggcaagggcctcgagtgggtcgccctcatctcctacgacggcaccaacaagtactacgtcgactccgtcaagggccgcttcaccatctcccgcgacaactccaagaacaccctctacctccagatgaactccctcaccgccgaggacaccgccgtctactactgcgccaaggacctcggcggctccaagaacgacgagtgggccaccgactactacgacctctccatcgcctaccccatccaggacccccgcgccgtcgccggcatcttcgacgtctggggccgcggcaccatggtcaccgtctcctcc

SEQ ID NO: 17526 - RNA, 432 nt, synthetic construct
  misc_feature 1..432: note = derived and/or modified sequence opt2 from anti-HIV_cap256-048-014521_VR-Chain
  source 1..432: mol_type = other RNA
gaggtccagctcgtcgagtccggcggcggcctcgtccagcccggccgctccctccgcctctcctgcgccgcctccggcttcatcttctcctcctacggcatccactgggtccgccagggccccggcaagggcctcgagtgggtcgccctcatctccggcgacggcaacaacaagtactacgccgactccgtccagggccgcttctccatctcccgcgacaactccaagaacaccctctacctccagatgaactccctccgcgccgaggacaccgccgtctactactgcgccaaggacctcggcgagtccgacaaggaggagtggccctccgactactacgacttcggccgcgacttcaccggccaggacccccgcgccgtcgtcggcgtcttcgacatctggggccagggcaccaccgtcatcgtctcctcc

SEQ ID NO: 17527 - RNA, 432 nt, synthetic construct
  misc_feature 1..432: note = derived and/or modified sequence opt2 from anti-HIV_cap256-048-014475_VR-Chain
  source 1..432: mol_type = other RNA
caggtccagctcgtcgagtccggcggcggcgtcgtccagcccggccgctccctccgcctctcctgcgccgcctccggcttcaccttcaacaccttcggcatgcactgggtccgccaggcccccggcaagggcctcgagtgggtcgccgtcatctcccacgacggcaacaacaagtactacgccgactccctcaagggccgcttcaccatctcccgcgagaactccaagaacaccctcttcctccagatgaactccctccgcgccgaggacacctccgtctactactgcgccaaggacctcggccacggcgagtgcgaggagtgggcctccgactactacgacttcggcaaggactacccctgcctcaccccccgcggcgtcgccggcaccttcgacatctggggccacggcaccaccgtcaccgtctcctcc

SEQ ID NO: 17528 - RNA, 432 nt, synthetic construct
  misc_feature 1..432: note = derived and/or modified sequence opt2 from anti-HIV_cap256-048-013798_VR-Chain
  source 1..432: mol_type = other RNA
caggtccagctcgtcgagtccggcggcggcgtcgtccagcccggccgctccctccgcctctcctgcgccgcctccggcttcaccttcaacaactacggcacccactgggtccgccaggcccccggcaagggcctcgagtgggtcgccgtcatctccgactccggctccaacaagtactacgccgactccgtcaagggccgcttcaccatctcccgcgacaactccaagaacaccctctacctccagatgaactccctccgcgccgaggacaccgccgtctacttctgcgccaaggacctcggcggccgcgagaccgaggagtgggcctccgactactacgacttcggccgcgacttccccggccaggaccagcgcgccgtcgccggcgtcttcgacatgtggggccagggcaccatggtcaccgtctcctcc

SEQ ID NO: 17529 - RNA, 432 nt, synthetic construct
  misc_feature 1..432: note = derived and/or modified sequence opt2 from anti-HIV_cap256-048-013271_VR-Chain
  source 1..432: mol_type = other RNA
gaggtccagctcgtcgagtccggcggcggcgtcgtccgccccggcggctccctccgcctctcctgcgccgcctccggcttcatcttctcctcctacggcatccactgggtccgccaggcccccggcaagggcctcgagtgggtcgccgtcatctccggcgacggcaccaacaagtactgcgccgactccgtcaagggccgcttcaccatctcccgcgacaactccaagaacaccctctacctccagatcaactccctccgcgtcgaggacaccgccgtctactactgcgccaaggacctcggcaagaacaaggacgacgagtgggccaccgactactacgacctctccatcgcctaccccgtccccgacccccgcgccgtcgtcggcgtcttcgacatctggggccagggcaccgtcgtcaccgtctcctcc

SEQ ID NO: 17530 - RNA, 432 nt, synthetic construct
  misc_feature 1..432: note = derived and/or modified sequence opt2 from anti-HIV_cap256-048-013180_VR-Chain
  source 1..432: mol_type = other RNA
caggtccagctcgtcgagtccggcggcggcgtcgtccagcccggccgctccctccgcctctcctgcgccgcctccggcttcaccttctccaagaacggcatgcactgggtccgccaggcccccggcaagggcctcgagtgggtcgccttcgtcgccttcgacggctccgacaagtactacgccgactccgtcaagggccgcttcgtcatctcccgcgacaactccaagaacaccctctccctccagatgaactccctccgcgccgaggacaccgccgtctactactgcgccaaggaggtcggcgaggacaaggacgacgagtgggcctccgactactacgacctctccatcgcctaccccgtccacgacccccgcgccgtcgtcggcggcttcgacatctggggccagggcaccatggtcaccgtctcctcc

SEQ ID NO: 17531 - RNA, 432 nt, synthetic construct
  misc_feature 1..432: note = derived and/or modified sequence opt2 from anti-HIV_cap256-048-012148_VR-Chain
  source 1..432: mol_type = other RNA
caggtccagctcgtcgagtccggcggcggcgtcgtccagcccggccgctccctccgcctctcctgcgccgcctccggcttcaccttcacccactacgccatggactgggtccgccaggcccccggcaagggcctcgagtgggtcgccgtcatctcctccgacggctcctccaagaactacgccgactccgtccgcggccgcttcaccatctcccgcgacaactccaagaacaccctctccctcctcatgaacggcctccgccccgaggacaccgccgtctactactgcgccaaggacgtcggcgacgtcaagaacgacgagtgggccaccgactactacgacctctccatcgcctaccccgtccaggacccccgcgccgtcgtcggcgccttcgacttctggggccagggcaccatggtcaccgtctccgcc

SEQ ID NO: 17532 - RNA, 432 nt, synthetic construct
  misc_feature 1..432: note = derived and/or modified sequence opt2 from anti-HIV_cap256-048-011870_VR-Chain
  source 1..432: mol_type = other RNA
caggtccagctcgtcgagtccggcggcggcgtcgtccagcccggccgctccctccgcctctcctgcgccgtctccggcttcaccttctccttctacggcatgcactgggtccgccaggcccccggcaagggcctcgagtgggtcgccgtcatctcctacgacggcaacaacaagtactacgtcgactccgtcaagggccgcttcatcatctcccgcgacaactccaagaacaccctctacctccagatgaactccctccgcgtcgaggacaccgccgtctactactgcgcccgcgacctcggcgagcgcgagaacgaggagtgggccaccgactactacgacttctccatcgcctaccccatcgagggcccccgcggcgtcgtcggcgtcttcgacatctggggccgcggcaccatggtcaccgtctcctcc

SEQ ID NO: 17533 - RNA, 432 nt, synthetic construct
  misc_feature 1..432: note = derived and/or modified sequence opt2 from anti-HIV_cap256-048-011530_VR-Chain
  source 1..432: mol_type = other RNA
caggtccacctcgtcgagtccggcggcggcgtcgtccagcccggccgctccctccgcctctcctgcgccgcctccggcttctccttccgcaactacgccatggactgggtccgccaggcccccggcaagggcctcgagtgggtcgccgtcatctcctccgacggctccgacaagcactacgccgactccgtccgcggccgcttcaccatctcccgcgacaactccaagaacaccctctacctccagatgaactccctccgcgtcgaggacaccgccgtctactactgcgccaaggacctcggcgccaacaagaacgacgagtgggccaccgactactacgacttctccatcgcctaccccgtccccgacccccgcgccgtcgtcggcgccttcgacatctggggccagggcaccatggtcaccgtctcctcc

SEQ ID NO: 17534 - RNA, 432 nt, synthetic construct
  misc_feature 1..432: note = derived and/or modified sequence opt2 from anti-HIV_cap256-048-010968_VR-Chain
  source 1..432: mol_type = other RNA
caggtccagctcgtcgagtccggcggcggcgtcgtccagcccggccgctccctccgcctctcctgcgccgcctccggcttcatcttctcctcctacggcatgcactgggtccgccaggcccccggcaagggcctcgagtgggtcgccctcatctccggcgacggctccaacaagtactacgccgactccgtcaagggccgcttcaccatctcccgcgacaactccaagaacaccctctacctccagatgaactccctccgcgccgaggactccgccctctacttctgcgccaaggacctcggcgagtccgacaaggaggagtggccctccgactactacgacttcggccgcgacttcaccggccaggtcccccgcgccgtcgtcggcatcttcgacatgtggggccagggcaccatggtcaccgtctcctcc

SEQ ID NO: 17535 - RNA, 426 nt, synthetic construct
  misc_feature 1..426: note = derived and/or modified sequence opt2 from anti-HIV_cap256-048-010224_VR-Chain
  source 1..426: mol_type = other RNA
gaggtccacctcgtcgagtccggcggcgacctcgtccagcccggcggctccctccgcctctcctgcgtcgtctccgagttcaccttctcctcctacggcatgcactgggtccgccaggcccccggcaagggcctcgagtgggtcgccttcatccgctacgacggctccaacaagtactacgccgactccgtcaagggccgcttcaccatctcccgcgacaactccaaggtctacctcgagatgaactccctccgcgccgaggacaccgccgtctactactgcgccaaggaggtcggcgagaacaaggacgacgagtgggcctccgactactacgacctctccatcgcctaccccatccacgacccccgcgccgtcgtcggcggcttcgacatctggggccagggcaccatggtcaccgtctcctcc

SEQ ID NO: 17536 - RNA, 432 nt, synthetic construct
  misc_feature 1..432: note = derived and/or modified sequence opt2 from anti-HIV_cap256-048-009749_VR-Chain
  source 1..432: mol_type = other RNA
caggtccagctcgtcgagtccggcggcggcgtcgtccagcccggccgctccctccgcctctcctgcggcgcctccggcttcaccttctcctcctacgccatgcactgggtccgccaggcccccggccgcggcctcgagtgggtcgccttcacctcctccgacggctccaacaagaactacggcgactccgtcaagggccgcttcaccatctcccgcgacaactccaagaacaccctcttcctccagatgaactccctccgcgccgaggacaccgccctctactactgcgccaaggacgtcggcgagtacaagtccgacgagtgggccaccgactactacgacctctccatcgcctaccccatccaggacccccgcgccatggtcggcgccttcgacatctggggccagggcaccatggtcaccgtctcctcc

SEQ ID NO: 17537 - RNA, 432 nt, synthetic construct
  misc_feature 1..432: note = derived and/or modified sequence opt2 from anti-HIV_cap256-048-009623_VR-Chain
  source 1..432: mol_type = other RNA
caggtccagctcgtcgagtccggcggcggcgtcgtccagcccggccgctccctccgcctctcctgcgccgcctccggcttctccttctccaagtacggcatgcactgggtccgccaggcccccggcaagggcctcgagtgggtcgccttcgtcgccttcgacgagggcgacaagtactacgtcgactccgtcaagggccgcttcaccatctcccgcgacaactccaagaacaccctctccctccagatgaactccctccgcgccgaggacaccgccgtctactactgcgccaaggaggtcggcgagaacaaggacgacgagtgggcctccgactactacgacctctccatcgcctaccccatccacgacccccgcgccgtcgtcggcggcttcgacatctggggccagggcaccatggtcaccgtctcctcc

SEQ ID NO: 17538 - RNA, 432 nt, synthetic construct
  misc_feature 1..432: note = derived and/or modified sequence opt2 from anti-HIV_cap256-048-008234_VR-Chain
  source 1..432: mol_type = other RNA
caggtccagctcgtcgagtccggcggcggcgtcgtccagcccggccgctccctccgcctctcctgcgccgcctccggcttcaccttcaccaactacgccatggactgggtccgccaggcccccggcaagggcctcgagtgggtcgccgtcatctcctccgacggctccaacaagaactacgccgactccgtcaagggccgcttcaccatctcccgcgacaactccaagaacaccgtctacctccagatgtcctccctccgccccgaggacaccgccgtctactactgcgccaaggacgtcggcgacaccaagtccgacgagtgggccaccgactactacgacctctccatcgcctaccccgtccaggacccccgcgccgtcgtcggcgccttcgacatctggggccagggcaccatggtcaccgtctcctcc

SEQ ID NO: 17539 - RNA, 432 nt, synthetic construct
  misc_feature 1..432: note = derived and/or modified sequence opt2 from anti-HIV_cap256-048-008149_VR-Chain
  source 1..432: mol_type = other RNA
caggtccagctcgtcgagtccggcggcggcgtcgtccagcccggccgctccctccgcctctcctgcgccgcctccggcttcaccttctccgtctacaccatgcactgggtccgccaggcccccggcaagggcctcgagtgggtcgccgtcatctcctacgacggccgcaacaagtactacgccgactccgtcaagggccgcttcaccatctcccgcgacaactccaagaacaccgtctacctccagatgaactccctccgcgtcgaggacaccgccgtctactactgcgccaaggacctcggcgccaacaaggacgacgagtgggccaccgactactacgacctctccgtcgcctaccccgtccccgacccccgcgccgtcgtcggcgccttcgacgtctggggccagggcaccatggtcaccgtctcctcc

SEQ ID NO: 17540 - RNA, 432 nt, synthetic construct
  misc_feature 1..432: note = derived and/or modified sequence opt2 from anti-HIV_cap256-048-007301_VR-Chain
  source 1..432: mol_type = other RNA
caggtccagctcgtcgagtccggcggcggcgtcgtccagcccggccgctccctccgcctctcctgcgccgcctccggcttctccttcaactactacgccatggactgggtccgccaggcccccggcaagggcctcgagtgggtcgccgtcatctcctccgacggccgcaacaagaactacgccgactccgtcaagggccgcttcaccatctcccgcgacaactccaagaacaccctctacctccagatgaactccctctccgtcgaggacaccgccgtctactactgcgccaaggacctcggcaagaacaaggacgacgagtgggccaccgactactacgacatctccatcgcctaccccgtccccgacccccgcgccgtcgtcggcgtcttcgacatctggggccagggcaccgtcgtcaccgtctcctcc

SEQ ID NO: 17541 - RNA, 432 nt, synthetic construct
  misc_feature 1..432: note = derived and/or modified sequence opt2 from anti-HIV_cap256-048-007174_VR-Chain
  source 1..432: mol_type = other RNA
caggtccagctcgtcgagtccggcggcggcgtcgtccagcccggccgctccctccgcctctcctgcgccgcctccggcttcaccttcaactcctacggcatggcctgggtccgccaggcccccggcaagggcctcgagtgggtcgccctcatctcctacgacggctccaacaagtactacgccgactccgtccgcggccgcttcaccatctcccgcgacaactccaaggacaccctctacctccagatggacggcctccgccccgaggacaccgccctctactactgcgccaaggacctcggcgagtccgagtgcgaggagtgggcctccgactactacgacttcggccgcgactacccctgcctcgccccccgcggcgtccccggcaccttcgacatctggggccagggcaccatggtcaccgtctcctcc

SEQ ID NO: 17542 - RNA, 432 nt, synthetic construct
  misc_feature 1..432: note = derived and/or modified sequence opt2 from anti-HIV_cap256-048-007079_VR-Chain
  source 1..432: mol_type = other RNA
caggtccagctcgccgagtccggcggcggcgtcgtccagcccggccgctccctccgcctctcctgcgccgcctccggcttcaccttctccatctacggcatgcactgggtccgccaggcccccggcaagggcctcgagtgggtcgccttcatcctctccgacggcaccgacaagtactccgccgactccgtcaagggccgcttcaccatctcccgcgacaactccaagaacaccctctacctccagatgaactccctccgcgccgaggacaccgccgtctactactgcgccaaggacctcggcaaggccaaggacgacgagtgggccaccgactactacgacttctccatcgcctaccccgtccacgacccccgcggcgtcgccggcatcttcgacatctggggccagggcaccatggtcaccgtctcctcc

SEQ ID NO: 17543 - RNA, 432 nt, synthetic construct
  misc_feature 1..432: note = derived and/or modified sequence opt2 from anti-HIV_cap256-048-007033_VR-Chain
  source 1..432: mol_type = other RNA
caggtccagctcgtcgagtccggcggcggcgtcgtccagcccggccgctccctccgcctctcctgcgccgcctccggcttcaccttctccaacttcggcttccactgggtccgccaggcccccggcaagggcctcgagtgggtcgccgccatctccttcgccggcaacaacaagtactacgccgactccgtcaagggccgcttcaccatctcccgcgagaactccaagaacatcctctacctccagatgaactccctccgcggcgaggacaccgccgtctactactgcgccaaggacctccgcgagttcgagtgcgaggagtgggcctccgactactacgacttcggccgcgactacccctgccaggacccccgcggcgtcgtcggcaccttcgacgtctggggccacggctccctcgtcaccgtctcctcc

SEQ ID NO: 17544 - RNA, 432 nt, synthetic construct
  misc_feature 1..432: note = derived and/or modified sequence opt2 from anti-HIV_cap256-048-006128_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccctcatctcctacgacggcaccgacaagtactacgccgactccgtcaagggccgcttcaccatctcccgcgacaactccaagaacaccctctacctccagatgaactccctccgcgtcgaggacaccgccgtctaccactgcgccaaggacctcggcggctccaagtccgacgagtgggccaccgactactacgactggtccatcgcctaccccgtccacgacccccgcgccgtcgtcggcgtcttcgacatctggggccagggcaccctcgtcaccgtctcctcc

SEQ ID NO: 17545 - RNA, 432 nt, synthetic construct
  misc_feature 1..432: note = derived and/or modified sequence opt2 from anti-HIV_cap256-048-005999_VR-Chain
  source 1..432: mol_type = other RNA
caggtccagctcgtcgagtccggcggcggcgtcgtccagcccggccgctccctccgcctctcctgcgccgcctccggcttcaccttcacccacttcgccatggactgggtccgccaggcccccggcaagggcctcgagtgggtcgccgtcatctcctccgacggctcctccaagaactacgccgactccgtcaagggccgcttcaccatctcccgcgacaactccaagaacaccgtctccctccagatgaactccctccgccccgaggacaccgccgtctactactgcgccaaggacctcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17546 - RNA, 432 nt, synthetic construct
  misc_feature 1..432: note = derived and/or modified sequence opt2 from anti-HIV_cap256-048-005394_VR-Chain
  source 1..432: mol_type = other RNA
caggtccagctcgtcgagtccggcggcggcgtcgtccagcccggccgctccctccgcctctcctgcgccgcctcccagttcaccttctcctcctacggcatgcactgggtccgccaggcccccggcaagggcctcgagtgggtcgccgccatctccttcgccggcaccaacaagtactacgccgactccgtcaagggccgcttcaccatctcccgcgacaactccaagaacgccctctacctccagatgaactccctccgcgccgaggacaccgccctctactactgcgccaaggacctccgcgagttcgagtgcgaggagtgggcctccgactactacgacttcggccgcgactacccctgccaggacccccgcggcgtcgtcggcaccttcgacatctggggccagggcaccatggtcaccgtctcctcc

SEQ ID NO: 17547 - RNA, 432 nt, synthetic construct
  misc_feature 1..432: note = derived and/or modified sequence opt2 from anti-HIV_cap256-048-004226_VR-Chain
  source 1..432: mol_type = other RNA
caggtccagctcgtcgagtccggcggcggcgtcgtccagcccggccgctccctccgcctctcctgcgccgcctccggcttcaccttcaacaagcacggcatgcactgggtccgccaggcccccggcaagggcctcgagtgggtcgccttcgtcgccttcgacggctccgacaagtactacgccgactccgtcaagggccgcttcaccatctcccgcgacaactccaagaacaccctctccctccagatgaacaacctccgcgccgaggacaccgccgtctactactgcgccaaggaggtcggcgacaacaaggacgacgagtgggcctccgactactacgacctctccatcgcctaccccgtccaggacccccgcgccgtcgtcggcggctacgacatctggggccagggcaccatggtcaccgtctcctcc

SEQ ID NO: 17548 - RNA, 432 nt, synthetic construct
  misc_feature 1..432: note = derived and/or modified sequence opt2 from anti-HIV_cap256-048-004097_VR-Chain
  source 1..432: mol_type = other RNA
caggtccagctcgtcgagtccggcggcggcgtcgtccagcccggccgctccctccgcctctcctgcgccgcctccggcttcaccttctccgcctacaccgtccactgggtccgccaggcccccggccgcggcctcgagtgggtctccgtcatctcctacgacgaccgcaacaagtactacgcccactccgtcaagggccgcttcaccatctcccgcgacaactccaagaacaccctctacctccagatgaactccctccgccgcgaggacaccgccgtctactactgcgccaaggacctcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17549 - RNA, 432 nt, synthetic construct
  misc_feature 1..432: note = derived and/or modified sequence opt2 from anti-HIV_cap256-048-003289_VR-Chain
  source 1..432: mol_type = other RNA
caggtccagctcgtcgagtccggcggcggcgtcgtccagcccggccgctccctccgcctctcctgcgccgcctccggcttcaccttctccaagtacggcatgcactgggtccgccaggcccccggcaagggcctcgagtgggtcgccttcgtcgccttcgacggctcctccaagaactacgccgactccgtcaagggccgcttcaccatctcccgcgacaactccaagaacaccgtctccctccagatgaactccctccgccccgaggacaccgccgtctactactgcgccaaggacctcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17550 - RNA, 432 nt, synthetic construct
  misc_feature 1..432: note = derived and/or modified sequence opt2 from anti-HIV_cap256-048-002601_VR-Chain
  source 1..432: mol_type = other RNA
caggtccagctcgtcgagtccggcggcggcgtcgtccagcccggccgctccctccgcctctcctgcgccgcctccggcttctccttcaacaactacgccatggactgggtccgccaggcccccggcaagggcctcgagtgggtcgccgtcatctcctccgacggccgcaacaagaactacgccgagtccgtcaagggccgcttcaccatctcccgcgacaactccaagaacaccgtctacctccagatgaactccctccgcgccgaggacaccgccgtctactactgcgccaaggacgtcggcgacaccaagaaggacgagtgggccaccgactactacgacctctccatcgcctaccccgtccaggacccccaggccgtcgtcggcgccttcgacatctggggccagggcaccatggtcaccgtctcctcc

SEQ ID NO: 17551 - RNA, 432 nt, synthetic construct
  misc_feature 1..432: note = derived and/or modified sequence opt2 from anti-HIV_cap256-048-002129_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccctcatctcctacgacggcaccgacaagtactacgccgactccgtcaagggccgcttcatcatctcccgcgacaactcccgctccaccctctacctccagatgaactccctccgcctcgaggacaccgccgtctaccactgcgccaaggacctcggcggctccaagtccgacgagtgggccaccgactactacgacctctccgtcgcctaccccgtccaggacccccgcgccgtcgtcggcgtcttcgacatctggggccagggcaccatggtcaccgtctcctcc

SEQ ID NO: 17552 - RNA, 432 nt, synthetic construct
  misc_feature 1..432: note = derived and/or modified sequence opt2 from anti-HIV_cap256-048-001875_VR-Chain
  source 1..432: mol_type = other RNA
caggtccagctcgtcgagtccggcggcggcgtcgtccagcccggcggctccctccgcctctcctgcgccacctccggcctcaccttctccaactacggcatgcactgggtccgccaggcccccggccgcggcctcgagtgggtcgccttcacccgctacgacggcacctacaactactacgccgactccgtcaagggccgcttcaccatctcccgcgacaactccaagggcaccctctacctccagatggacggcctccgccccgaggacaccgccctctactactgcgccaaggacctcggcgagcgcgagtgcgaggagtgggcctccgactactacgacttcggccgcgacttcccctgccaggacccccgcggcgtcgtcggcaccttcgacatctggggccagggcaccatggtcaccgtctcctcc

SEQ ID NO: 17553 - RNA, 432 nt, synthetic construct
  misc_feature 1..432: note = derived and/or modified sequence opt2 from anti-HIV_cap256-048-001302_VR-Chain
  source 1..432: mol_type = other RNA
caggtccagctcgtcgagtccggcggcggcgtcgtccagcccggccgctccctccgcctctcctgcgccgcctccggcttcaccttctcctactccggcatgcactgggtccgccaggcccccggcaagggcatggagtgggtcgccgtcatctcctacgacggctccaacaagtactacgccgactccgtcaagggccgcttcaccatctcccgcgacaactccaagaacaccgtctacctccagatgaactccctccgcggcgtcgacaccgccgtctactactgcgccaaggacctcggcggcggcgaggtcgaggagtgggccaccgactactacgactggtccatcgcctaccccgtcgagcacccccgcgccgtcgtcggcgtcttcgacatctggggccagggcaccaaggtcaccgtctcctcc

SEQ ID NO: 17554 - RNA, 432 nt, synthetic construct
  misc_feature 1..432: note = derived and/or modified sequence opt2 from anti-HIV_cap256-048-001203_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccatcatctcctacgacggcaccatcaagtactacgccgactccgtcaagggccgcttcaccatctcccgcgacaactccaagaacaccgtctccctccagatgaactccctccgccccgaggacaccgccgtctactactgcgccaaggacgtcggcgccaacaaggacgacgagtgggccaccgactactacgacctctccatcgcctaccccgtccccgacccccgcgccgtcgtcggcgccttcgacatctggggccagggcaccatggtcaccgtctcctcc

SEQ ID NO: 17555 - RNA, 432 nt, synthetic construct
  misc_feature 1..432: note = derived and/or modified sequence opt2 from anti-HIV_cap256-048-000383_VR-Chain
  source 1..432: mol_type = other RNA
caggtccagctcgtcgagtccggcggcggcgtcgtccagcccggccgctccctccgcctctcctgcaccgcctccggcttcaccttcaaccactacgccatggactgggtccgccaggcccccggcaagggcctcgagtgggtcgccgtcatctcctccgacggctccgacaagacctacgccgactccgtcaagggccgcttcaccatctcccgcgacaactccaagaacaccgtctacctccagatgaactccctccgcgccgaggacaccgccgtctactactgcgccaaggacgtcggcggctccaaggacgacgagtgggccaccgactactacgacctctccatcgcctaccccgtccccgacccccgcgccgtcgtcggcgccttcgacttctggggccccggcaccatggtcaccgtctcctcc

SEQ ID NO: 17556 - RNA, 432 nt, synthetic construct
  misc_feature 1..432: note = derived and/or modified sequence opt2 from anti-HIV_cap256-038-261791_VR-Chain
  source 1..432: mol_type = other RNA
caggtccagctcgtcgagttcggcggcggcgtcgtccagcccggcggctccctccgcctctcctgcgccgccttcggcttcaccatctcctcctacggcatgcactgggtccgccaggcccccggcaagggcctccagtgggtcgccttcatccgctacgacgagtcctccaagttctacgccgactccgtcaagggccgcttcaccatctcccgcgacaactccgagaacaccctctacctccagatgaactccctccgcgccgaggacaccgccgtctactactgcgccaaggacctcggcgagtccgagaacgaggagtgggccaccgactactacgacttctccatcgcctaccccggccaggacccccgcggcgtcgtcggcatcttcgacatctggggccagggcaccatggtcaccgtctcctcc

SEQ ID NO: 17557 - RNA, 432 nt, synthetic construct
  misc_feature 1..432: note = derived and/or modified sequence opt2 from anti-HIV_cap256-038-241540_VR-Chain
  source 1..432: mol_type = other RNA
caggtccagctcgtcgagtccggcggcggcgtcgtccagcccggccgctccctccgcctctcctgcgccgcctccggcttcaccttctccaactccgccatgcactgggtccgccaggcccccggcaagggcctcgagtgggtcgccctcatctcctacgtcggcggcaacatctactacgccgactccgtcaagggccgcttcaccgtctcccgcgacaactccaagaagaccctctacctccagatgaactccctccgcgtcgaggacaccgccgtctactactgcgtcaaggacgtcggcgagtccgagaacgaggagtgggcctccgactactacgacttcggccgcgactaccccggccaggacacccgcgccgtcgtcggcgccttcgacatctggggccagggcaccatggtcaccgtctcctcc

SEQ ID NO: 17558 - RNA, 432 nt, synthetic construct
  misc_feature 1..432: note = derived and/or modified sequence opt2 from anti-HIV_cap256-038-235677_VR-Chain
  source 1..432: mol_type = other RNA
ctcgtccagctcgtcgagtccggcggcggcgtcgtccagcccggcggctccctccgcctctcctgcgccgcctccggcttccgcttctcctcctacggcatgcactgggtccgccaggcccccggcaagggcctcgagtgggtcgccttcatccgctacgacggctccttcaaggactacgccgactccgtccgcggccgcttcaccatctcccgcgagaactccaagaacaccctctacctccagatgaactccctccgcaccgacgacaccgccgtctactactgcgccaaggacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17559 - RNA, 435 nt, synthetic construct
  misc_feature 1..435: note = derived and/or modified sequence opt2 from anti-HIV_cap256-038-234314_VR-Chain
  source 1..435: mol_type = other RNA
gaggtccagctcctcgagtccggcggcggcctcgtccagcccggcggctccctccgcctctcctgcgccgcctccggcttcaccttctcccgctacgccatgtcctgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgtcgacaccgccgtctactactgcgccaaggacctcggcgagggcgagaacgaggagtgggccaccgactactacgacttctcctactggctcccctgccccaagtaccacggcgcctggctcgagctcctctacatctggggccagggcaccatggtcaccgtctcctcc

SEQ ID NO: 17560 - RNA, 432 nt, synthetic construct
  misc_feature 1..432: note = derived and/or modified sequence opt2 from anti-HIV_cap256-038-234273_VR-Chain
  source 1..432: mol_type = other RNA
gaggtccagctcgtcgagtccggcggcggcctcatccagcccggcggctccctccgcctctcctgcgccgcctccggcttcaccgtctccaccaacttcatgtcctgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcaccgacgacaccgccgtctactactgcgccaaggacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17561 - RNA, 432 nt, synthetic construct
  misc_feature 1..432: note = derived and/or modified sequence opt2 from anti-HIV_cap256-038-223164_VR-Chain
  source 1..432: mol_type = other RNA
gaggtccagctcgtcgagtccggcggcggcctcgtccgccccggcggctccctccgcctctcctgcgccgcctccggcttctccctcggctcctactggatgacctgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccctctactactgcgccaaggacctcggcgagtccgagaacgaggagtgggcctccgactactacgacttcggccgcgactaccccggccaggacccccgcggcgtcgtcggcaccttcgacatctggggccagggcaccatggtcaccgtctcctcc

SEQ ID NO: 17562 - RNA, 432 nt, synthetic construct
  misc_feature 1..432: note = derived and/or modified sequence opt2 from anti-HIV_cap256-038-220289_VR-Chain
  source 1..432: mol_type = other RNA
gaggtccagctcgtcgagtccggcggcggcctcgtccagcccggcggctccctccgcctctcctgcaccgcctccggcttcaccttctcctcctacgagatgaactgggtccgccaggcccccggcaagggccccgagtgggtcgccgtcatctcctacgacggcaacaacaagtactacgccgactccgtcaagggccgcttcaccatctcccgcgagaactccaagaacaccctctacctccagatgaactccctccgcaccgacgacaccgccgtctactactgcgccaaggacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17563 - RNA, 432 nt, synthetic construct
  misc_feature 1..432: note = derived and/or modified sequence opt2 from anti-HIV_cap256-038-220020_VR-Chain
  source 1..432: mol_type = other RNA
caggtccagctcgtcgagtccggcggcggcgtcgtccagcccggccgctccctccgcctctcctgcgccgcctccggcttcaccttctcccgcaacgccatgcactgggtccgccaggcccccggcaagggcctcgagtgggtcgccctcatctcctacgacggctccaacaagtactacgtcgactccgtcaagggccgcttcaccatctcccgcgacaactccaagaacaccctctacctccagatgaactccctccgcgccgacgacaccgccgtctactactgcgccaaggacctcggcgagtccgagaccgaggagtggggcaccgactactacgacttctccaccggctaccccgtccaggacccccgcggcgtcgtcggcgccttcgacatctggggccagggcaccatggtctccgtctcctcc

SEQ ID NO: 17564 - RNA, 432 nt, synthetic construct
  misc_feature 1..432: note = derived and/or modified sequence opt2 from anti-HIV_cap256-038-216853_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacgtccagatgaactccctccgcgccgaggacaccgccgtctactactgcgcccgcgacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17565 - RNA, 432 nt, synthetic construct
  misc_feature 1..432: note = derived and/or modified sequence opt2 from anti-HIV_cap256-038-213466_VR-Chain
  source 1..432: mol_type = other RNA
gaggtccagctcgtcgagtccggcggcggcctcgtccagcccggccgctccctccgcgtctcctgcgccgcctccggcttcaccttcgaggactacgccatgcactgggtccgccaggcccccggcaagggcctcgagtgggtcgccgtcatctccgacgacggcaacaacaagtactacgccgactccgtcaagggccgcttcaccatctcccgcgacaactccaagaacaccctctacctccagatgaactccctccgcgtcgaggacaccgccgtctactactgcgtcaaggacgtcggcgagtccgagaacgaggagtgggcctccgactactacgacttcggccgcgactaccccggccaggacacccgcgccgtcgtcggcgccttcgacatctggggccagggcaccatggtcaccgtctcctcc

SEQ ID NO: 17566 - RNA, 432 nt, synthetic construct
  misc_feature 1..432: note = derived and/or modified sequence opt2 from anti-HIV_cap256-038-213212_VR-Chain
  source 1..432: mol_type = other RNA
caggtccagctcgtcgagtccggcggcggcgtcgtccagcccggcggctccctccgcctctcctgcgccgcctccggcttcatcttctccgactacggcatgcactgggtccgccaggcccccggcaagggcctcgagtgggtcgcctccatctggcacgacggctccaagaagtactacgccgactccgtcaagggccgcttcaccatctcccgcgagaactccaagaacaccctctacctccagatgaactccctccgcgccgaggacaccgccgtctaccactgcgccaaggacctcggcgagtccgagatcgaggagtggacctccgactactacgacttcggccgcgactaccccggccaggacccccgcggcgtcttcggcaccttcgacatctggggccacggcaccatggtcaccgtctcctcc

SEQ ID NO: 17567 - RNA, 432 nt, synthetic construct
  misc_feature 1..432: note = derived and/or modified sequence opt2 from anti-HIV_cap256-038-213120_VR-Chain
  source 1..432: mol_type = other RNA
caggtccacctcgtcgagtccggcggcggcctcgtcaagcccggcggctccctccgcctctcctgcgccgcctccggcttcaccttctccgactactacatgatctggatccgccaggcccccggcaagggcctcgagtgggtcgccgtcatctcctccgacggctccaacaagaactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttcgccaccggctaccccgtccaggacccccgcgccgtcgtcggcgccttcgacatctggggccagggcaccatggtcaccgtctccccc

SEQ ID NO: 17568 - RNA, 432 nt, synthetic construct
  misc_feature 1..432: note = derived and/or modified sequence opt2 from anti-HIV_cap256-038-212592_VR-Chain
  source 1..432: mol_type = other RNA
ctcgtccagctcgtcgagtccggcggcggcgtcgtccagcccggcaagtccctccgcctctcctgcgccgcctccggcttcaccttctcctcctacgccatgcactggatccgccaggcccccggcaagggcctcgagtgggtcgccgtcatctccgacgacggctccatcaagaactacgccgactccgtcaagggccgcttcaccatctcccgcgacacctccaagaagctcatgtacctccagatgaactccctctccgccaacgacaccgccgtctactactgcgccaaggacctcggcgagcgcgagaacgaggagtgggcctccgactactacgacttcggccgcgactaccccggccaggacccccgcggcgtcgtcggctccatcgacacctggggccacggcaccatggtcaccgtctcctcc

SEQ ID NO: 17569 - RNA, 432 nt, synthetic construct
  misc_feature 1..432: note = derived and/or modified sequence opt2 from anti-HIV_cap256-038-211790_VR-Chain
  source 1..432: mol_type = other RNA
gagctccagctcgtcgagtccggcggcggcctcgtccagcccggcggctccctccgcctctcctgcgtcgtctccggcttcaccgtctccaccaactacatctcctgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccctctactactgcgccaaggacctcggcgagtccgagaacgaggagtgggcctccgactactacgacttcggccgcgactaccccggccaggacccccgcggcgtcgtcggcaccttcgacatctggggccagggcaccatggtcaccgtctcctcc

SEQ ID NO: 17570 - RNA, 432 nt, synthetic construct
  misc_feature 1..432: note = derived and/or modified sequence opt2 from anti-HIV_cap256-038-209916_VR-Chain
  source 1..432: mol_type = other RNA
caggtccagctcgtcgagtccggcggcggcgtcgtccagcccggcggctccctccgcctctcctgcgccgcctccggcttcaccttctcctccttcggcatgcactgggtccgccaggcccccggcaagggcctcgagtgggtctccttcatccgcaacgacggcggcatccgctactccgccgactccgtccgcggccgcttcaccatctcccgcgacaactccaagaacaccctctacctccagatgaactccctccgcaccgacgacaccgccgtctactactgcgccaaggacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17571 - RNA, 432 nt, synthetic construct
  misc_feature 1..432: note = derived and/or modified sequence opt2 from anti-HIV_cap256-038-207938_VR-Chain
  source 1..432: mol_type = other RNA
caggtccagctcgtcgagtccggcggcggcgtcgtccaccccggccgctccctccgcctctcctgcgccgcctccggcttcaccttctcctcctacggcatgcactgggtccgccaggcccccggcaagggcctcgagtgggtcgccgtcatctcccacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggccgcgactaccccggccaggacccccgcggcgtcgtcggcgtcttcgacatctggggccagggcaccatggtcaccgtctcctcc

SEQ ID NO: 17572 - RNA, 432 nt, synthetic construct
  misc_feature 1..432: note = derived and/or modified sequence opt2 from anti-HIV_cap256-038-202245_VR-Chain
  source 1..432: mol_type = other RNA
caggtccacctcgtcgagtccggcggcggcgtcgtccagcccggccgctccctccgcctctcctgcaccgtctccggcttcaccttcggctcctacgccctccactgggtccgccaggcccccggcaagggcctcgagtggctctccgtcatctcctacgacggcaacaacaagtactacgccgactccgtcaagggccgcttcaccatctcccgcgagaactccaagaacaccctctacctccagatgaactccctccgcgccgaggacaccgccgtctaccactgcgccaaggacctcggcgagtccgagaaggaggagtgggcctccgactactacgacttcggccgcgactaccccggccaggacccccgcggcgtcgtcggcaccttcgacatctggggccacggcaccatggtcaccgtctcctcc

SEQ ID NO: 17573 - RNA, 432 nt, synthetic construct
  misc_feature 1..432: note = derived and/or modified sequence opt2 from anti-HIV_cap256-038-197721_VR-Chain
  source 1..432: mol_type = other RNA
caggtccagctcgtcgagtccggcggcggcgtcgtccagcccggcaagtccctccgcctctcctgcgccggctccggcttcatcttctccaactaccccatgcactgggtccgccaggcccccggcaagggcctcgagtggatggccgacgtctcctacgacggctccaacaaggactacgccgactccgtcaagggccgcttcaccatctcccgcgacaactccaagaacaccctctacctccagatgaactccctccgcgccgaggacaccgccgtctactactgcgtcaaggacgtcggcgagtccgagaacgaggagtgggcctccgactactacgacttcggccgcgactaccccggccaggacacccgcgccgtcgtcggcgccttcgacatctggggccagggcaccatggtcaccgtctcctcc

SEQ ID NO: 17574 - RNA, 432 nt, synthetic construct
  misc_feature 1..432: note = derived and/or modified sequence opt2 from anti-HIV_cap256-038-196679_VR-Chain
  source 1..432: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtcgccgtcatctcctacgacggcggcaacaagtactacgccgactccgtcaagggccgcttcaccatctcccgcgacaactccaagaacaccctctacctccagatgaactccctccgcgccgaggacaccgccctctactactgcgccaaggacctcggcgagtccgagaacgaggagtgggcctccgactactacgacttcggccgcgactaccccggccaggactcccgcggcgtcgtcggcaccttcgacgtctggggccagggcaccatggtcaccgtctcctcc

SEQ ID NO: 17575 - RNA, 438 nt, synthetic construct
  misc_feature 1..438: note = derived and/or modified sequence opt2 from anti-HIV_cap256-038-196118_VR-Chain
  source 1..438: mol_type = other RNA
caggtccagctcgtcgagtccggcggcggcgtcgtccagcccggcggctccctccgcctctcctgcgccgcctccggcttcaccttctccacctacggcatgcactgggtccgccaggcccccggcaagggcctcgagtgggtcaccttcatccgcaacgacggcaccaacaagtactacgccgactccgtcaagggccgcttcaccatctcccgcgacaacaccaagaacaccctctacctccagatgtactccctccgcgccgaggacaccgccgtctactactgcgccaaggacctcggcgagtccgagaacgaggacgaggagtgggcctccgactactacgacttcggccgcgactaccccggccaggactcccgcggcgtcgtcggcaccttcgacatgtggggccagggcaccatggtcaccgtctcctcc

SEQ ID NO: 17576 - RNA, 429 nt, synthetic construct
  misc_feature 1..429: note = derived and/or modified sequence opt2 from anti-HIV_cap256-038-195382_VR-Chain
  source 1..429: mol_type = other RNA
caggtccacctcgtcgagtccggcggcggcgtcgtccagcccggccgctccctccgcctctcctgcgccgcctccggcttcaccttctccaactaccccgtccactgggtccgccaggcccccggcaagggcctcgagtgggtcgccgtcatctccttcgacggcatcaacaactacgccggctccgtcaagggccgcttcatcatctcccgcgacaactccaagaacaccctctacctccagatgaactccctccgcgccgaggacaccgccgtctactactgcgtcaaggacctcggcgagtccgagaaggaggagtggccctccgactactacgacttcggccgcgactaccccggccaggactcccgcggcgtcgtcggcgtcttcgacatctggggccagggcaccatggtcaccgtctcctcc

SEQ ID NO: 17577 - RNA, 432 nt, synthetic construct
  misc_feature 1..432: note = derived and/or modified sequence opt2 from anti-HIV_cap256-038-180001_VR-Chain
  source 1..432: mol_type = other RNA
gaggtccagctcgtcgagtccggcggcggcctcgtccagcccggccgctccctccgcctctcctgcaccgcctccggcttcaccttcggcgactacgccatgtcctggttccgccaggcccccggcaagggcctcgagtgggtcgccgacatctcctacgacggctccaacaagtactacgccgactccgtcaagggccgcctcaccatctcccgcgacaactccaagaacaccctctacctccagatgaactccctccgcgccgaggacaccgccgtctactactgcgtcaaggacctcggcgagtccgagaaggaggagtggccctccgactactacgacttcggccgcgactaccccggccaggactcccgcggcgtcgtcggcgtcttcgacatctggggccagggcaccatggtcaccgtctcctcc

SEQ ID NO: 17578 - RNA, 432 nt, synthetic construct
  misc_feature 1..432: note = derived and/or modified sequence opt2 from anti-HIV_cap256-038-178021_VR-Chain
  source 1..432: mol_type = other RNA
caggtcaagctcgtcgagtccggcggcggcgtcgtccagcccggcggctccctccgcctctcctgcgccgccgccggcttcatcttctccaactccggcatgcactgggtccgccaggcccccgacaagggcctcgagtgggtcgccttcgtcccctacgacggctccaacaagtactacgccgactccgtcaagggccgcttcaccatctcccgcgacaactccaagaacaccctctccctccagatgaactccctccgcaccgaggacaccgccgtctactactgcgccaaggacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17579 - RNA, 432 nt, synthetic construct
  misc_feature 1..432: note = derived and/or modified sequence opt2 from anti-HIV_cap256-038-177104_VR-Chain
  source 1..432: mol_type = other RNA
gaggtccagctcctcgagtccggcggcggcctcgtccagcccggcggctccctccgcctctcctgcgccgcctccggcttcaccttctcctcctacgccatgaactgggtccgccaggcccccggcaagggcctcgagtgggtcgccgtcatctcctacgacggcggcgacaagtactacgccgactccgtcaagggccgcttcaccatctcccgcgacaactccaagaacaccctctacctccagatgaactccctccgcgtcgaggacaccgccgtctactactgcgtcaaggacgtcggcgagtccgagaacgaggagtgggcctccgactactacgacttcggccgcgactaccccggccaggacacccgcgccgtcgtcggcgccttcgacatctggggccagggcaccatggtcaccgtctcctcc

SEQ ID NO: 17580 - RNA, 432 nt, synthetic construct
  misc_feature 1..432: note = derived and/or modified sequence opt2 from anti-HIV_cap256-038-171261_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgtactgggtccgccaggcccccggcaagggcctcgagtgggtcgccgtcatctcctccgacggctccgacaagaactacgccgactccgtcaagggccgcttcaccatctcccgcgacaactccaacaacaccctctacctccagatgaactccctccgcgccgaggacaccgccgtctactactgcgcccgcgacctcggcgagtccgagaacgaggagtggccctccgactactacgacttcggccgcgactaccccggccaggacccccgcggcgtcatcggcaccttcgacgtctggggccagggcaccatggtcaccgtctcctcc

SEQ ID NO: 17581 - RNA, 432 nt, synthetic construct
  misc_feature 1..432: note = derived and/or modified sequence opt2 from anti-HIV_cap256-038-169090_VR-Chain
  source 1..432: mol_type = other RNA
caggtccagctcgtcgagtccggcggcggcgtcgtccagcccggccgctccctccgcctctcctgcgccgcctcccgcttcaccttcaagacctacaccatgcactgggtccgccaggcccccggcaagggcctcgagtgggtcgccctcatctcctacgacggctccaacaagtactacgccgactccgtcaagggccgcctcaccatctcccgcgacaactccaagaacaccctctacctccagatgaactccctccgcgccgaggacaccgccgtctactactgcgtcaaggacctcggcgagtccgagaaggaggagtggccctccgactactacgacttcggccgcgactaccccggccaggactcccgcggcgtcgtcggcgtcttcgacatctggggccagggcaccatggtcaccgtctcctcc

SEQ ID NO: 17582 - RNA, 432 nt, synthetic construct
  misc_feature 1..432: note = derived and/or modified sequence opt2 from anti-HIV_cap256-038-168705_VR-Chain
  source 1..432: mol_type = other RNA
gaggtccagctcgtcgagtccggcggcggcctcgtcaagcccggcggctccctccgcctctcctgcgccgcctccggcttcaccttctcctcctactccatgaactgggtccgccgcgcccccggcaagggcctcgagtgggtcgccctcatctcctacgacgagaacaagaagtactacgccgactccgtcaagggccgcttcaccatctcccgcgagaactccaagaacaccctctacctccagatgaactccctccgcgccgaggacaccgccgtctactactgcgccaaggacctcggcgagcgcgagaacgaggagtgggcctccgactactacgacttcggccgcgactaccccggccaggacccccgcggcgtcgtcggctccatcgacacctggggccacggcaccatggtcaccgtctcctcc

SEQ ID NO: 17583 - RNA, 432 nt, synthetic construct
  misc_feature 1..432: note = derived and/or modified sequence opt2 from anti-HIV_cap256-038-167685_VR-Chain
  source 1..432: mol_type = other RNA
caggtccagctcgtcgagtccggcggcggcgtcgtccagcccggccgctccctccgcctctcctgcgccgcctccggcatcaccttctcctcctacgccatccactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctccatcggctaccccggccaggacccccgcggcgtcgtcggcgccttcgacatctggggccagggcaccatggtcaccgtctccctc

SEQ ID NO: 17584 - RNA, 432 nt, synthetic construct
  misc_feature 1..432: note = derived and/or modified sequence opt2 from anti-HIV_cap256-038-158775_VR-Chain
  source 1..432: mol_type = other RNA
caggtccagctcgtcgagtccggcggcggcgtcgtccagcccggcggctccctccgcctctcctgcgccgcctccggcttcaccttctccacctacggcatgcactgggtccgccaggcccccggcaagggcctcgagtgggtcgccttcatccgcgacaacggctccaacaagtactacgccgactccgtcaagggccgcttcaccatctcccgcgacaactccaagaacaccctctacctccagatgaactccctccgcgccgaggacaccgccctctactactgcgccaaggacctcggcgagtccgagaacgaggagtgggcctccgactactacgacttcggccgcgactaccccggccaggactcccgcggcgtcgtcggcaccttcgacgtctggggccagggcaccatggtcaccgtctcctcc

SEQ ID NO: 17585 - RNA, 432 nt, synthetic construct
  misc_feature 1..432: note = derived and/or modified sequence opt2 from anti-HIV_cap256-038-157318_VR-Chain
  source 1..432: mol_type = other RNA
cacgtccagctcgtcgagtccggcggcggcgtcgtccagcccggccgctccctccgcctctcctgcgccgcctccggcatcaccttctccacctacgacatgcactgggtccgccaggcccccggcaagggcctcgagtgggtcgccgtcatctccaacgacggctccaacaagtactacgccgactccgtcaagggccgcttcaccatctcccgcgacaactccaagaacaccctctacctccagatgaactccctccgcgccgaggacaccgccctctactactgcgccaaggacctcggcgagtccgagaaggaggagtgggcctccgactactacgacttcggccgcgactaccccggccaggacccccgcggcgtcgtcgccaccttcgacatctggggccagggcaccatggtcaccgtctcctcc

SEQ ID NO: 17586 - RNA, 432 nt, synthetic construct
  misc_feature 1..432: note = derived and/or modified sequence opt2 from anti-HIV_cap256-038-153058_VR-Chain
  source 1..432: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccgtcatctcctacgacggctcccactcctactacgccggctccgtcaagggccgcttcaccacctcccgcgacaactccaagaacaccctcaacctccagatgaactccctccgccccgaggacaccgccctctactactgcgccaaggacctcggcgagtccgagaacgaggagtgggcctccgactactacgacttcggccgcgactaccccggccaggactcccgcggcgtcgtcggcaccttcgacgtctggggccagggcaccatggtcaccgtctcctcc

SEQ ID NO: 17587 - RNA, 432 nt, synthetic construct
  misc_feature 1..432: note = derived and/or modified sequence opt2 from anti-HIV_cap256-038-150027_VR-Chain
  source 1..432: mol_type = other RNA
ctcgtccagctcgtcgagtccggcggcggcgtcgtccagcccggcggctccctccgcctctcctgcgccgcctccggcttccgcttctcctcctacggcatgcactgggtccgccaggcccccggcaagggcctcgagtgggtcgccttcatccgctacgacggctccttcaaggactacgccgactccgtccgcggccgcttcaccatctcccgcgacaactccaagaacaccgtctacgtccagatgaactccctccgcgccgaggacaccgccgtctactactgcgccaaggacctcggcgagtccgagaacgaggagtgggccaccgactactacgacttcgccaccggctaccccgtccaggacccccgcgccgtcgtcggcgccttcgacatctggggccagggcaccatggtcaccgtctccccc

SEQ ID NO: 17588 - RNA, 432 nt, synthetic construct
  misc_feature 1..432: note = derived and/or modified sequence opt2 from anti-HIV_cap256-038-146372_VR-Chain
  source 1..432: mol_type = other RNA
caggtccagctcgtcgagtccggcggcggcgtcgtccagcccggccgctccctccgcctctcctgcgccgcctccggcttcaccttctcctccttcggcatgcactgggtccgccagtcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcaccgacgacaccgccgtctactactgcgccaaggacctcggcgagtccgagaccgaggagtgggccaccgactactacgacttcgccaccggctaccccgtccaggacccccgcgccgtcgtcggcgccttcgacatctggggccagggcaccatggtcaccgtctccccc

SEQ ID NO: 17589 - RNA, 432 nt, synthetic construct
  misc_feature 1..432: note = derived and/or modified sequence opt2 from anti-HIV_cap256-038-141868_VR-Chain
  source 1..432: mol_type = other RNA
gagctccgcctcgtcgagtccggcggcaacctcgtccagcccggcggctccctcaccctctcctgcgtcgcctccggcttcaccttcgactcctacggcatgtcctgggtccgccaggcccccggcaagggcctcgagtgggtcgccctcatctcctacgacgagaacaagaagtactacgccgactccgtcaagggccgcttcaccatctcccgcgagaactccaagaacaccctctacctccagatgaactccctccgcgccgaggacaccgccgtctactactgcgccaaggacctcggcgagcgcgagaacgaggagtgggcctccgactactacgacttcggccgcgactaccccggccaggacccccgcggcgtcgtcggctccatcgacacctggggccacggcaccatggtcaccgtctcctcc

SEQ ID NO: 17590 - RNA, 432 nt, synthetic construct
  misc_feature 1..432: note = derived and/or modified sequence opt2 from anti-HIV_cap256-038-141616_VR-Chain
  source 1..432: mol_type = other RNA
gaggtccagctcctcgagtccggcggcggcctcgtccagcccggcggctccctccgcctctcctgcgccgcctccggcttcaccttctcctcctacgccatgtcctgggtccgccaggcccccggcaagggcctcgagtgggtcgccgtcatctccaaggacggctccgacaactcctacgtcgactccgtcaagggccgcttcaccatctcccgcgacaactccaagaacaccctctacctccagatgaactccctccgcgccgaggacaccgccgtctactactgcgcccgcgacctcggcgagtccgagaacgaggagtggccctccgactactacgacttcggccgcgactaccccggccaggacccccgcggcgtcatcggcaccttcgacgtctggggccagggcaccatggtcaccgtctcctcc

SEQ ID NO: 17591 - RNA, 432 nt, synthetic construct
  misc_feature 1..432: note = derived and/or modified sequence opt2 from anti-HIV_cap256-038-127989_VR-Chain
  source 1..432: mol_type = other RNA
caggcccagctcgtcgagtccggcggcggcgtcgtccagcccggccgctccctccgcctctcctgcgccgcctccggcttcaccttctccaacttcgccatgcactgggtccgccaggcccccggcaagggcctcgagtgggtcgccgtcatgtccgacgacggctccaacaagtactacgccgactccgtcaagggccgcttcaccatctcccgcgacaactccgagaacaccctctacctccagatgaactccctccgcgccgaggacaccgccgtctactactgcgccaaggacctcggcgagtccgagaccgaggagtgggccaccgactactacgacttcggcaccggctaccccggccaggacccccgcgccatgatcggcaccttcgacatctggggccgcggcaccatggtcaccgtctcctcc

SEQ ID NO: 17592 - RNA, 432 nt, synthetic construct
  misc_feature 1..432: note = derived and/or modified sequence opt2 from anti-HIV_cap256-038-118109_VR-Chain
  source 1..432: mol_type = other RNA
caggtccagctcgtcgagtccggcggcggcgtcgtccagcccggcggctccctccgcctctcctgcaccgcctccggcttcaccttctccgcctacgacatgcactggatccgccaggcccccggcaagggcctcggctgggtcgccttcatcaccaacgagggctcctccaagaactacgtcgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctccatcgcctaccccggccaggacccccgcggcgtcgtcggcatcttcgacatctggggccagggcaccatggtcaccgtctcctcc

SEQ ID NO: 17593 - RNA, 432 nt, synthetic construct
  misc_feature 1..432: note = derived and/or modified sequence opt2 from anti-HIV_cap256-038-112226_VR-Chain
  source 1..432: mol_type = other RNA
gaggtccagctcgtcgagtccggcggcggcctcgtccagcccggcggctccctccgcctctcctgcgccgcctccggcttcaccttctcctcctactggatgacctgggtccgccaggcccccggcaagggcctcgagtgggtcgccgtcatctccgacgacggcaacaacaagtactacgccgactccgtcaagggccgcttcaccatctcccgcgacaactccaagaacaccctctacctccagatgaactccctccgcgtcgaggacaccgccgtctactactgcgtcaaggacgtcggcgagtccgagaacgaggagtgggcctccgactactacgacttcggccgcgactaccccggccaggacacccgcgccgtcgtcggcgccttcgacatctggggccagggcaccatggtcaccgtctcctcc

SEQ ID NO: 17594 - RNA, 432 nt, synthetic construct
  misc_feature 1..432: note = derived and/or modified sequence opt2 from anti-HIV_cap256-038-105918_VR-Chain
  source 1..432: mol_type = other RNA
gaggtccagctcctcgagtccggcggcggcctcgtccagcccggcggctccctccgcctctcctgcgccgcctccggcttcaccttcaacatccaccccatgcactgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcaccgacgacaccgccgtctactactgcgccaaggacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17595 - RNA, 432 nt, synthetic construct
  misc_feature 1..432: note = derived and/or modified sequence opt2 from anti-HIV_cap256-038-104487_VR-Chain
  source 1..432: mol_type = other RNA
ctcgtccagctcgtcgagtccggcggcggcgtcgtccagcccggcaagtccctccgcctctcctgcgccgcctccggcttcaccttctcctcctacgccatgcactggatccgccaggcccccggcaagggcctcgagtgggtcgccgtcatctccgacgacggctccatcaagaactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacggcttctccatcggctaccccggccaggacccccgcggcgtcgtcggcatcttcgacatctgggcccagggcaccatggtcaccgtctcctcc

SEQ ID NO: 17596 - RNA, 432 nt, synthetic construct
  misc_feature 1..432: note = derived and/or modified sequence opt2 from anti-HIV_cap256-038-102308_VR-Chain
  source 1..432: mol_type = other RNA
caggtccagctcgtcgagtccggcggcggcgtcgtccagcccggcggctccctccgcctctcctgcgccgccctcgacttccccttctcctccttcggcatgcactgggtccgccagacccccggccgcggcctcgagtgggtcgccatcatctggtccgacggctccaaccgctactacgtcgactccgtcaagggccgcttcaccatctcccgcgacaactccaagaacaccctctacctccagatgaactccctccgccccgacgacaccgccgtctactactgcgtcaaggacctcggcgagtccgagaacgaggagtgggccaccgactactacgacttctccgtcggctaccccggccagggcccccgcggcgtcgtcggcatcttcgacatctggggccagggcaccatggtcaccgtctcctcc

SEQ ID NO: 17597 - RNA, 432 nt, synthetic construct
  misc_feature 1..432: note = derived and/or modified sequence opt2 from anti-HIV_cap256-038-091115_VR-Chain
  source 1..432: mol_type = other RNA
caggtccagctcgtcgagtccggcggcggcgtcgtccagcccggccgctccctccgcctctcctgcgccgtctccggcttcaccttctcctcctacggcctccactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatcaactccctccgcgccgaggacaccgccgtctactactgcgccaaggacctcggcgagtccgagaacgaggagtgggccaccgactactacgacttctccatcggctaccccggccaggacccccgcgccgtcgtcggcgccttcgacatctggggccagggcaccatggtcaccgtctcctcc

SEQ ID NO: 17598 - RNA, 432 nt, synthetic construct
  misc_feature 1..432: note = derived and/or modified sequence opt2 from anti-HIV_cap256-038-090262_VR-Chain
  source 1..432: mol_type = other RNA
caggtccagctcgtcgagtccggcggcggcgtcgtccaggccggcggctccctccgcctctcctgcgccgcctccggcttcaccttcaacaactacggcatgcactgggtccgccaggcccccggcaagggcctcgagtgggccgccttcatccgctacgacggctccaacaagtactacgccgactccgtccgcggccgcttcaccatctcccgcgacaactccaagaacaccctctacctccagatgaactccctccgcgccgaggacaccgccgtctactactgcgtcaaggacgtcggcgagtccgagaacgaggagtgggcctccgactactacgacttcggccgcgactaccccggccaggacacccgcgccgtcgtcggcgccttcgacatctggggccagggcaccatggtcaccgtctcctcc

SEQ ID NO: 17599 - RNA, 432 nt, synthetic construct
  misc_feature 1..432: note = derived and/or modified sequence opt2 from anti-HIV_cap256-038-083260_VR-Chain
  source 1..432: mol_type = other RNA
caggtccagctcgtcgagtccggcggcggcctcgtcaagcccggcggctccctccgcctctcctgcgccgcctccggcttcaccttctccgactactacatgacctggatccgccaggcccccggcaagggcctcgagtgggtcgccgtcatctcctacgacggcggcaacaagtactacgccgactccgtcaagggccgcttcaccatctcccgcgacaactccaagaacaccctctacctccagatgaactccctccgcgccgaggacaccgccctctactactgcgccaaggacctcggcgagtccgagaacgaggagtgggcctccgactactacgacttcggccgcgactaccccggccaggactcccgcggcgtcgtcggcaccttcgacgtctggggccagggcaccatggtcaccgtctcctcc

SEQ ID NO: 17600 - RNA, 432 nt, synthetic construct
  misc_feature 1..432: note = derived and/or modified sequence opt2 from anti-HIV_cap256-038-080981_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcatggagtgggtcgccgtcatctcctacgacggctccaacaagtactacgccgactccgtcaagggccgcttcaccatctcccgcgacaactccaagaacaccctctacctccagatgaactccctccgcgccgtcgacaccgccgtctactactgcgccaaggacctcggcgagggcgagaacgaggagtgggccaccgactactacgacttctccatcggctaccccggccaggacccccgcggcgtcgtcggcgccttcgacatctggggccagggcaccatggtcaccgtctcctcc

SEQ ID NO: 17601 - RNA, 432 nt, synthetic construct
  misc_feature 1..432: note = derived and/or modified sequence opt2 from anti-HIV_cap256-038-080873_VR-Chain
  source 1..432: mol_type = other RNA
ctcgtccagctcgtcgagtccggcggcggcgtcgtccagcccggcggctccctccgcctctcctgcgccgcctccggcttccgcttctcctcctacggcatgcactgggtccgccaggcccccggcaagggcctcgagtgggtcgccttcatccgctacgacggctccttcaaggactacgccgactccgtccgcggccgcttcaccatctcccgcgacaactccaagaacaccgtctacctccagatgaactccctccgcgccgaggacaccgccgtctactactgcgtcaaggacctcggcgagtccgagaaggaggagtggccctccgactactacgacttcggccgcgactaccccggccaggactcccgcggcgtcgtcggcgtcttcgacatctggggccagggcaccatggtcaccgtctcctcc

SEQ ID NO: 17602 - RNA, 432 nt, synthetic construct
  misc_feature 1..432: note = derived and/or modified sequence opt2 from anti-HIV_cap256-038-074413_VR-Chain
  source 1..432: mol_type = other RNA
caggtccagctcgtcgagtccggcggcggcgtcgtccagcccggcggctccctccgcctctcctgcgccgcctccggcttcaccttctccacctacggcatgcactgggtccgccagccccccggcaagggcctcgagtgggtcgccttcatccgctacgacggctccaacacctactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggcctccgactactacgacttcggccgcgactaccccggccaggacccccgcggcgtcgtcggcgtcttcgacatctggggccagggcaccatggtcaccgtctcctcc

SEQ ID NO: 17603 - RNA, 432 nt, synthetic construct
  misc_feature 1..432: note = derived and/or modified sequence opt2 from anti-HIV_cap256-038-073153_VR-Chain
  source 1..432: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccctcatctcctacgacggcaccaacaagtactacgccgactccgtcaagggccgcttcaccatctcccgcgacaactccaagaacaccctcttcctccagatgaactccctccgcgccgaggacaccgccctctactactgcgccaaggacctcggcgagtccgagaacgaggagtgggcctccgactactacgacttcggccgcgactaccccggccaggacccccgcggcgtcgtcggcaccttcgacatctggggccagggcaccatggtcaccgtctcctcc

SEQ ID NO: 17604 - RNA, 432 nt, synthetic construct
  misc_feature 1..432: note = derived and/or modified sequence opt2 from anti-HIV_cap256-038-064227_VR-Chain
  source 1..432: mol_type = other RNA
gaggtccaggtcgtcgagtccggcggcggcctcgtccagcccggcggctccctccgcctctcctgcgccgcctccggcttcaccttctccaactactggatgtcctgggtccgccaggcccccggcaagggcctcgagtgggtcgccgtcatgtccttctccggctccggctcctactacgccgactccgtcaagggccgcttcaccatctcctccgacgactccatgaacaccgtctacctccagatgaactccctccgcgccgaggacaccgccgtctactactgcgccaaggacctcggcgagcgcgagaacgaggagtgggcctccgactactacgacttcggccgcgactaccccggccaggacccccgcggcgtcgtcggctccatcgacacctggggccacggcaccatggtcaccgtctcctcc

SEQ ID NO: 17605 - RNA, 432 nt, synthetic construct
  misc_feature 1..432: note = derived and/or modified sequence opt2 from anti-HIV_cap256-038-061640_VR-Chain
  source 1..432: mol_type = other RNA
caggtccagctcgtcgagtccggcggcggcgtcgtccagcccggccgctccctccgcctctcctgcaccgcctcccgcttctccttcaacaactacgccatgcactgggtccgccaggcccccggcaagggcctcgagtgggtcgccatcatctccaaggacggctccgacaactcctacgtcgactccgtcaagggccgcttcaccatctcccgcgacaactccaagaacaccctctacctccagatgaactccctccgcgccgaggacaccgccgtctactactgcgcccgcgacctcggcgagtccgagaacgaggagtggccctccgactactacgacttcggccgcgactaccccggccaggacccccgcggcgtcatcggcaccttcgacgtctggggccagggcaccatggtcaccgtctcctcc

SEQ ID NO: 17606 - RNA, 414 nt, synthetic construct
  misc_feature 1..414: note = derived and/or modified sequence opt2 from anti-HIV_cap256-038-059482_VR-Chain
  source 1..414: mol_type = other RNA
cgcggcgtccagtgccaggtccagctcgtcgagtccggcggcggcgtcgtccagcccggcttcaccttctcctcctacgtcatgcactgggtccgccaggcccccggcaagggcctcgagtgggtcgccgacatctcctacgacggctccaacaagtactacgccgactccgtcaagggccgcctcaccatctcccgcgacaactccaagaacaccctctacctccagatgaactccctccgcgccgaggacaccgccgtctactactgcgtcaaggacctcggcgagtccgagaaggaggagtggccctccgactactacgacttcgccaccggctaccccgtccaggacccccgcgccgtcgtcggcgccttcgacatctggggccagggcaccatggtcaccgtctccccc

SEQ ID NO: 17607 - RNA, 432 nt, synthetic construct
  misc_feature 1..432: note = derived and/or modified sequence opt2 from anti-HIV_cap256-038-054000_VR-Chain
  source 1..432: mol_type = other RNA
gaggtccagctcgtcgagtccggcggctccgtcgtccgccccggcggctccctccgcctctcctgcgccgcctccggcttcaccttcgacgactccggcatgtcctgggtccgccagggccccggcaagggcctcgagtgggtcgccgtcatctcctacgacggcggcaacaagtactacgccgactccgtcaagggccgcttcaccatctcccgcgacaactccaagaacaccctctacctccagatgaactccctccgcgccgaggacaccgccctctactactgcgccaaggacctcggcgagtccgagaacgaggagtgggcctccgactactacgacttcggccgcgactaccccggccaggactcccgcggcgtcgtcggcaccttcgacgtctggggccagggcaccatggtcaccgtctcctcc

SEQ ID NO: 17608 - RNA, 432 nt, synthetic construct
  misc_feature 1..432: note = derived and/or modified sequence opt2 from anti-HIV_cap256-038-050554_VR-Chain
  source 1..432: mol_type = other RNA
gaggtccagctcctcgagtccggcggcgacctcgtccagtccggcggctccctccgcctctcctgcgtcgcctccggcttcaccttctccacccacgccatgacctgggtccgccaggcccccggcaagggcctcgagtgggtcgccgtcatctcctccgacggctccaacaagaacttcgccgactccgtcaagggccgcttcaccatctcccgcgacaactccaagaacaccctctacctccagatgaactccctccgccccgaggacaccgccgtctactactgcgccaaggacctcggcgagtccgagaacgaggagtgggccaccgactactacgacttctccaccggctaccccgtccaggacccccgcgccgtcgtcggcgccttcgacatctggggccagggcaccatggtcaccgtctcctcc

SEQ ID NO: 17609 - RNA, 432 nt, synthetic construct
  misc_feature 1..432: note = derived and/or modified sequence opt2 from anti-HIV_cap256-038-044256_VR-Chain
  source 1..432: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctccaacaagtaccacgccggctccgtcaagggccgcttcatcatctcccgcgacaactccaagaacaccctctacctccagatgaactccctccgcgccgaggacaccgccctctactactgcgccaaggacctcggcgagtccgagaacgaggagtgggcctccgactactacgacttcggccgcgactaccccggccaggacccccgcggcgtcgtcggcaccttcgacatctggggccagggcaccatggtcaccgtctcctcc

SEQ ID NO: 17610 - RNA, 432 nt, synthetic construct
  misc_feature 1..432: note = derived and/or modified sequence opt2 from anti-HIV_cap256-038-040944_VR-Chain
  source 1..432: mol_type = other RNA
caggtccagctcgtcgagtccggcggcggcgtcgtccagcccggccgctccctccgcctctcctgcgccgcctccggcttcaccttctccaactacgccatggactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctccaccggctaccccggccaggacccccgcgccgtcgtcggcgccttcgacatctggggccagggcaccatggtcaccgtctcctcc

SEQ ID NO: 17611 - RNA, 432 nt, synthetic construct
  misc_feature 1..432: note = derived and/or modified sequence opt2 from anti-HIV_cap256-038-040090_VR-Chain
  source 1..432: mol_type = other RNA
caggtccagctcgtcgagtccggcggcggcgtcgtccagcccggccgctccctccgcctctcctgcgccgcctccggcttctccttctccaactacgccatggactgggtccgccaggcccccggcaagggcctcgagtgggtcgccgtcatctcctccgacggctccaacaagaactacgccgactccgtcaagggccgcttcaccatctcccgcgacaactccaagaacaccctctacctccagatggactccctccgcgccgacgacaccgccgtctactactgcgccaaggacctcggcgagtccgagaacgaggagtgggccaccgactactacgacttctccatcggctaccccgtccaggacccccgcggcgtcgtcggcatcttcgacatctggggccagggcaccatggtcaccgtctcctcc

SEQ ID NO: 17612 - RNA, 432 nt, synthetic construct
  misc_feature 1..432: note = derived and/or modified sequence opt2 from anti-HIV_cap256-038-032874_VR-Chain
  source 1..432: mol_type = other RNA
caggtccagctcgtcgagtccggcggcggcgtcgtccagcccggcggctccctccgcctctcctgcgccgcctccggcttcaccttctcctcctacggcatgcactgggtccgccaggcccccggcaagggcctcgagtgggtcgccttcatccgctacgacggcaacaacaagtactacgccgactccgtcaagggccgcttcaccatctcccgcgagaactccaagaacaccctctacctccagatgaactccctccgcgccgaggacaccgccgtctaccactgcgccaaggacctcggcgagtccgagaaggaggagtgggcctccgactactacgacttcggccgcgactaccccggccaggacccccgcggcgtcgtcggcaccttcgacatctggggccacggcaccatggtcaccgtctcctcc

SEQ ID NO: 17613 - RNA, 432 nt, synthetic construct
  misc_feature 1..432: note = derived and/or modified sequence opt2 from anti-HIV_cap256-038-025899_VR-Chain
  source 1..432: mol_type = other RNA
caggtccagctcgtcgagtccggcggcggcgtcgtccagcccggccgctccctccgcctctcctgcgtcgcctccggcttcaccttctccaactacgccatgtactgggtccgccaggcccccggcaagggcctcgagtgggtcaccatcatctccttcgacggctccaaccagtactacgccgactccgtcaagggccgcttcaccatctcccgcgagaactccaagaacaccctctacctccagatgaactccctccgcgccgaggacaccgccgtctactactgcgccaaggacctcggcgagcgcgagaacgaggagtgggcctccgactactacgacttcggccgcgactaccccggccaggacccccgcggcgtcgtcggctccatcgacacctggggccacggcaccatggtcaccgtctcctcc

SEQ ID NO: 17614 - RNA, 432 nt, synthetic construct
  misc_feature 1..432: note = derived and/or modified sequence opt2 from anti-HIV_cap256-038-024581_VR-Chain
  source 1..432: mol_type = other RNA
cacatccagctcgtcgagtccggcggcggcgtcgtccagcccggcggctccctccgcctctcctgcgccgcctccggcttccccttctcctccttcggcatgcactgggtccgccagacccccggccgcggcctcgagtgggtcgccatcatctggtccgacggctcccacaaggagtacaccgactccgtcaagggccgcttcaccatctcccgcgacaactcccgctccaccatggacctccagatgaacaacctccgccccgaggacaccgccgtctactactgcgccaaggacctcggcgagcgcgagaacgaggagtgggcctccgactactacgacttcggccgcgactaccccggccaggacccccgcggcgtcgtcggctccatcgacacctggggccacggcaccatggtcaccgtctcctcc

SEQ ID NO: 17615 - RNA, 432 nt, synthetic construct
  misc_feature 1..432: note = derived and/or modified sequence opt2 from anti-HIV_cap256-038-013345_VR-Chain
  source 1..432: mol_type = other RNA
caggtccagctcgtcgagtccggcggcggcgtcgtccagcccggccgctccctccgcctctcctgcgccgtctccggcttcaccttctcctcctacggcatgcactgggtccgccaggcccccggcaagggcctcgagtgggtcgccgccatctcctacgacggctccaacaagtactacgtcgactccgtcaagggccgcttcaccatctcccgcgacaactccaagaacaccctctacctccagatgaactccctccgcgccgaggacaccgccgtctactactgcgcccgcgacctcggcgagcgcgagatcgaggagtgggccaccgactactacgacttctccatcggctaccccggccaggacccccgcggcgtcgtcggcgtcttcgacatctggggccagggcaccatggtcaccgtctcctcc

SEQ ID NO: 17616 - RNA, 438 nt, synthetic construct
  misc_feature 1..438: note = derived and/or modified sequence opt2 from anti-HIV_cap256-038-011559_VR-Chain
  source 1..438: mol_type = other RNA
caggtccagctcgtcgagtccggcggcggcgtcgtccagcccggccgctccctccgcctctcctgcgaggcctccggcttcaccttctcctcctacggcatggactgggtccgccaggcccccggcaagggcctcgagtgggtcgccctcatctcccacgacggctccaacaagcactacgccgactccgtcaagggccgcttcaccatctcccgcgacaactcccgcaacaccctctacctccagatgaactccctccgcgccgaggacaccgccctctactactgcgccaaggacctcggcgagtccgagaacgaggacgaggagtgggcctccgactactacgacttcggccgcgactaccccggccaggactcccgcggcgtcgtcggcaccttcgacatgtggggccagggcaccatggtcaccgtctcctcc

SEQ ID NO: 17617 - RNA, 432 nt, synthetic construct
  misc_feature 1..432: note = derived and/or modified sequence opt2 from anti-HIV_cap256-038-009634_VR-Chain
  source 1..432: mol_type = other RNA
caggtccagctcgtcgagtccggcggcggcgtcgtccagcccggccgctccctccgcctctcctgcgccgcctccggcttcaccttcacctccttcggcatgcactgggtccgccaggcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcgccgaggacaccgccgtctaccactgcgccaaggacctcggcgagtccgagatcgaggagtggacctccgactactacgacttcggccgcgactaccccggccaggacccccgcggcgtcttcggcaccttcgacatctggggccacggcaccatggtcaccgtctcctcc

SEQ ID NO: 17618 - RNA, 432 nt, synthetic construct
  misc_feature 1..432: note = derived and/or modified sequence opt2 from anti-HIV_cap256-038-006730_VR-Chain
  source 1..432: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgccgtcatctccaaggacggctccgacaactcctacgtcgactccgtcaagggccgcttcaccatctcccgcgacaactccaagaacaccctctacctccagatgaactccctccgcgccgaggacaccgccgtctactactgcgcccgcgacctcggcgagtccgagaacgaggagtggccctccgactactacgacttcggccgcgactaccccggccaggacccccgcggcgtcatcggcaccttcgacgtctggggccagggcaccatggtcaccgtctcctcc

SEQ ID NO: 17619 - RNA, 432 nt, synthetic construct
  misc_feature 1..432: note = derived and/or modified sequence opt2 from anti-HIV_cap256-038-004887_VR-Chain
  source 1..432: mol_type = other RNA
caggtccagctcgtcgagtccggcggcggcgtcgtccagcccggccgctccctccgcctctcctgcgccgcctccggcttctccttctccacctccggcatgcactgggtccgccaggcccccggcaagggcatggagtgggtcgccgtcatctcctacgacggctccaacaagtactacgccgactccgtcaagggccgcttcaccatctcccgcgacaactccaagaacaccctctacctccagatgaactccctccgcgccgtcgacaccgccgtctactactgcgccaaggacctcggcgagggcgagaacgaggagtgggccaccgactactacgacttctccatcggctaccccgtccagaacccccgcggcctcgtcggcgccttcgacatctggggccagggcaccatggtcaccgtctcctcc

SEQ ID NO: 17620 - RNA, 432 nt, synthetic construct
  misc_feature 1..432: note = derived and/or modified sequence opt2 from anti-HIV_cap256-038-004840_VR-Chain
  source 1..432: mol_type = other RNA
caggtccagctcgtcgagtccggcggcggcgtcgtccagcccggccgctccctccgcctctcctgcgccgcctccggcttcaccttctcctccttcggcatgcactgggtccgccagtcccccggcaagggcctcgagtgggtcgccgtcatctcctacgacggcaacaacaagtactacgccgactccgtcaagggccgcttcaccatctcccgcgagaactccaagaacaccctctacctccagatgaactccctccgcaccgacgacaccgccgtctactactgcgccaaggacctcggcgagtccgagaccgaggagtggccctccgactactacgacttcggccgcgactaccccggccaggacccccgcggcgtcgtcggcaccttcgacatctggggccacggcaccatggtcaccgtctcctcc

SEQ ID NO: 17621 - RNA, 432 nt, synthetic construct
  misc_feature 1..432: note = derived and/or modified sequence opt2 from anti-HIV_cap256-038-002181_VR-Chain
  source 1..432: mol_type = other RNA
gaggtccagctcgtcgagtccggcggcggcctcgtccagcccggccgctccctccgcctctcctgcgccgcctccggcttcaccttcgaggactacgccatgcactgggtccgccaggcccccggcaagggcctcgagtgggtcgccgtcatctcctacgacggctccaacaagtactacgtcgactccgtcaagggccgcttcaccatctcccgcgacaactccaagaacaccctctacctccagatgaactccctccgcgccgaggacaccgccgtctactactgcgccaaggacctcggcgagtccgagaacgaggagtgggccaccgactactacgacttctccatcggctaccccggccaggacccccgcggcgtcgtcggcatcttcgacatctggggccagggcaccatggtcaccgtctcctcc

SEQ ID NO: 17622 - RNA, 432 nt, synthetic construct
  misc_feature 1..432: note = derived and/or modified sequence opt2 from anti-HIV_cap256-038-001902_VR-Chain
  source 1..432: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgccgtcatctcctacgacggcaacaacaagtactacgccgactccgtcaagggccgcttcaccatctcccgcgagaactccgagaacaccctctacctccagatgaactccctccgcgccgacgacaccgccgtctactactgcgccaaggacctcggcgagtccgagaacgaggagtgggcctccgactactacgacttcggccgcgactaccccggccaggacacccgcggcgtcgtcggcaccttcgacatctggggccacggcaccatggtcaccgtctcctcc

SEQ ID NO: 17623 - RNA, 432 nt, synthetic construct
  misc_feature 1..432: note = derived and/or modified sequence opt2 from anti-HIV_cap256-038-000976_VR-Chain
  source 1..432: mol_type = other RNA
caggtccagctcgtcgagtccggcggcggcgtcgtccagcccggccgctccctccgcctctcctgcgccgcctccggcttcaccttctcctccttcggcatgcactgggtccgccaggcccccggcaagggcctcgagtgggtcgccgtcatctccgacgacggcaacaacaagtactacgccgactccgtcaagggccgcttcaccatctcccgcgacaactccaagaacaccctctacctccagatgaactccctccgcgtcgaggacaccgccgtctactactgcgtcaaggacgtcggcgagtccgagaacgaggagtgggcctccgactactacgacttcggccgcgactaccccggccaggacacccgcgccgtcgtcggcgccttcgacatctggggccagggcaccatggtcaccgtctcctcc

SEQ ID NO: 17624 - RNA, 432 nt, synthetic construct
  misc_feature 1..432: note = derived and/or modified sequence opt2 from anti-HIV_cap256-038-000384_VR-Chain
  source 1..432: mol_type = other RNA
caggtccagctcgtcgagtccggcggcggcgtcgtccagcccggcaagtccctccgcctctcctgcgccgcctccggcttcaccttctcctcctacgtcatgcactgggtccgccaggcccccggcaagggcctcgagtgggtcgccgacatctcctacgacggctccaacaagtactacgccgactccgtcaagggccgcctcaccatctcccgcgacaactccaagaacaccctctacctccagatgaactccctccgcgccgaggacaccgccgtctactactgcgtcaaggacctcggcgagtccgagaaggaggagtggccctccgactactacgacttcggccgcgactaccccggccaggactcccgcggcgtcgtcggcgtcttcgacatctggggccagggcaccatggtcaccgtctcctcc

SEQ ID NO: 17625 - RNA, 321 nt, synthetic construct
  misc_feature 1..321: note = derived and/or modified sequence opt2 from anti-HIV_206-314431_VR-Chain
  source 1..321: mol_type = other RNA
cagttcgtcctcacccagcccccctccgtctccgccgcccccggccagaacgtcaccatctcctgctccggccccccctcccacatcgagaagaacgacgtctcctggtaccagcgcctccccggcatggcccccaagatggtcatctacgagtcccgccgccgccccctcggcatccccgtccgcttcaccgcctcccgctccggctcctccgccaccctcgtcatcaccggcctccagaccgccgacgaggccgactactactgcggcacctgggacggccgcatgaacttcggcaccggcaccaccgtcaccgtcctc

SEQ ID NO: 17626 - RNA, 321 nt, synthetic construct
  misc_feature 1..321: note = derived and/or modified sequence opt2 from anti-HIV_206-247594_VR-Chain
  source 1..321: mol_type = other RNA
cagtccatcctcacccagcccccctccgtctccgccgcccccggccagaacgtcaccatctcctgctccggccccccctcccacatcgagaagaacgacgtctcctggtaccagcgcttccccggcatggcccccaagatgatcatctacgagtccaagcgccgccccttcggcgtccccggccgcttctccgcctcccgctccggcaagtccgccaccctcgccatcaccggcctccagaccggcgacgaggccgactactactgcggcacctgggacggccgcatgaacttcggcaccggcaccaccgtcaccgtcctc

SEQ ID NO: 17627 - RNA, 321 nt, synthetic construct
  misc_feature 1..321: note = derived and/or modified sequence opt2 from anti-HIV_206-116890_VR-Chain
  source 1..321: mol_type = other RNA
cagtccgtcctcacccagcccccctccgtctccgccgcccccggccagaacgtcaccatctcctgctccggccccccctcccacatcgagaagaacgacgtctcctggtaccagcacctccccggcgaggcccccaagatgatcatctacgagtcctggcgccgccccgccggcatccccgcccgcttctccgcctcccgctccggcaagtccggcaccctcgccatcaccggcctccagaccggcgacgaggccgactactactgcggcacctggaacggccgcatgaacttcggcaccggcaccaccgtcaccgtcctc

SEQ ID NO: 17628 - RNA, 333 nt, synthetic construct
  misc_feature 1..333: note = derived and/or modified sequence opt2 from anti-HIV_206-072383_VR-Chain
  source 1..333: mol_type = other RNA
cagtccgtcctcacccagcccccctccgtctccgccgcccccggccagcgcgtcatcatctcctgctccggcaacaactccaccatcggcaacaacttcgtctcctggtaccagcaggtccccggcaccgcccccaagctcctcatctacgagaccaaccgccgcccctccggcatccccgaccgcttctccggctccaagtccggcacctccgccaccctcgccatctccggcctccagaccggcgacgaggccgacttctactgcaccgtctggggcgtccgcaagggcgtcgccgccgtcttcggcaccggcacccgcctcaccgtcctc

SEQ ID NO: 17629 - RNA, 333 nt, synthetic construct
  misc_feature 1..333: note = derived and/or modified sequence opt2 from anti-HIV_206-037527_VR-Chain
  source 1..333: mol_type = other RNA
cagtccgtcctcacccagcccccctccgtctccgccgcccccggccagaaggtcatcatctcctgctccggcaacaactccaccatcggcaagatcctcgtctcctggtaccagcaggtccccggcaccgcccccaagctcgtcatctacgagaccaaccgccgcccctccggcatccccgaccgcttctccggctccaagtccggcacctccgccaccctcgccatcaccggcctccagaccggcgacgaggccgactacttctgcaaggtctggggcgtccgcaagggcgtcgccgccgtcttcggcaccggcaccaaggtcaccgtcctc

SEQ ID NO: 17630 - RNA, 333 nt, synthetic construct
  misc_feature 1..333: note = derived and/or modified sequence opt2 from anti-HIV_206-009095_VR-Chain
  source 1..333: mol_type = other RNA
cagtccgtcctcacccagcccccctccgtctccgccgcccccgcccagcgcgtcatcatctcctgctccggcgacaactccaccatcggcaacaacttcgtctcctggtaccagcaggtccccggcgccgcccccaagctcctcatctacgagaccaaccgccgcccctccggcatccccgaccgcttctccggctccaagtccggcaccaccgccaccctcgccatctccggcctccagaccggcgacgaggccgactaccactgcaccgtctggggcgtccgcaagggcgtcgccgccgtcttcggcaccggcaccaaggtcaccgtcctc

SEQ ID NO: 17631 - RNA, 321 nt, synthetic construct
  misc_feature 1..321: note = derived and/or modified sequence opt2 from anti-HIV_176-503620_VR-Chain
  source 1..321: mol_type = other RNA
cagtccgtcctcacccagcccccctccgtctccaccgcccccggccagaccgtcaccgtctcctgctccggcggcacctccaacaccggcaacaacttcgtctcctggtaccagcacctccccggcaccgcccccaagctcctcatctacgagaacaacaagcgccccctcggcgtccccgaccgcttctccggcgccaagtccggcacctccgccaccctcgccctcaccggcctccagaccggcgacgagggcgactactactgcgccacctggtccggctccctcaacatcggcaccggcaccaaggtctccgtcctc

SEQ ID NO: 17632 - RNA, 321 nt, synthetic construct
  misc_feature 1..321: note = derived and/or modified sequence opt2 from anti-HIV_176-478726_VR-Chain
  source 1..321: mol_type = other RNA
cagtccgtcctcacccagcccccctccgtctccgccgcccccggccagaacgtcaacatctcctgctccggccccccctcccacatcgagcgcaacgacgtctcctggtaccagcacctccccggcgccgcccccaagatgatcatctacgagtcctggcgccgccccgccggcatccccgaccgcttctccgcctcccgctccggcgcctccgccaccctcgccatcaccggcctccagaccggcgacgaggccgactactactgcggcacctggaacggccgcatgaacttcggcaccggcaccaccgtcaccgtcctc

SEQ ID NO: 17633 - RNA, 321 nt, synthetic construct
  misc_feature 1..321: note = derived and/or modified sequence opt2 from anti-HIV_176-245056_VR-Chain
  source 1..321: mol_type = other RNA
cagtccgtcctcacccagcccccctccgtctccgccgcccccggccagaacgtcaccatctcctgctccggccccccctcccacatcgagaagaacggcgtctcctggtaccagcagttccccggcatggcccccaagatggtcatctacgagtccaagcgccgccccttcggcgtccccgcccgcttctccgcctcccgctccggcaagtccgccaccctcgccatcaccggcctccagaccggcgacgaggccgactactactgcggcacctgggacggccgcatgaacttcggcaccggcaccaccgtcaccgtcctc

SEQ ID NO: 17634 - RNA, 321 nt, synthetic construct
  misc_feature 1..321: note = derived and/or modified sequence opt2 from anti-HIV_176-164413_VR-Chain
  source 1..321: mol_type = other RNA
cagtccgtcctcacccagcccccctccgtctccgccgcccccggccagaaggtcaccatctcctgctccggcggcacctccaacatcggcaacaactacgtctcctggtaccagcgcctccccggcaccgcccccaagctcctcatctacgagaacaacaagcgcccctccggcatccccgaccgcttctccggccccaagtccggcacctccgccaccctcgccatcaccggcctccagcccggcgacgaggccgactactactgcgccacctggtccggctccctcaacttcggcaccggcaccaaggtcaccgtcctc

SEQ ID NO: 17635 - RNA, 333 nt, synthetic construct
  misc_feature 1..333: note = derived and/or modified sequence opt2 from anti-HIV_176-094308_VR-Chain
  source 1..333: mol_type = other RNA
cagtccgtcctcacccagcccccctccgtctccgccgcccccggccagaaggtcatcatctcctgctccggcaacaactccaccatcggcaacaacttcgtctcctggtaccagcaggtccccggcaccgcccccaagctcctcgtctacgagacctaccgccgcccctccggcatccccgaccgctcctccggctccaagtccggcaccaccgccacccaggccatctccggcctccagaccggcgacgaggccgactaccactgcaccgtctggggcgtccgcaagggcgtcgccgccgtcttcggcaccggcaccaaggtcaccgtcctc

SEQ ID NO: 17636 - RNA, 333 nt, synthetic construct
  misc_feature 1..333: note = derived and/or modified sequence opt2 from anti-HIV_176-065321_VR-Chain
  source 1..333: mol_type = other RNA
cagtccgtcctcacccagcccccctccgtctccgccgcccccggccgccgcgtcatcatctcctgctccggcaacaactccaccatcggcaacaacttcgtctcctggtaccagcaggtccccggcaccgcccccaagctcctcgtctacgagaccaaccgccgcccctccggcatccccgaccgcttctccggctccaagtccggcacctccgccaccctcgccatctccggcctccagaccggcgacgaggccgactactactgcaccgtctggggcgtccgcaagggcgtcgccgccgtcttcggcaccggcaccaaggtcaccgtcctc

SEQ ID NO: 17637 - RNA, 324 nt, synthetic construct
  misc_feature 1..324: note = derived and/or modified sequence opt2 from anti-HIV_119-099719_VR-Chain
  source 1..324: mol_type = other RNA
cagtccgtcctcacccagcccccctccgtctccgccgcccccggccagaaggtcaccatctcctgctccggctccaactcctacatcggcaacaagtacatctcctggtaccagcagttccccggcaccgcccccaagctcctcatctacgagaacaacaagcgcccctccggcgtccccgaccgcttctccgcctccaagtccgccacctccgccaccctcgccatcaccggcctccacaccggcgacgaggccgactactactgcgagacctgcgacggctccggcggcgtcttcggcaccggcaccaaggtcaccgtcctc

SEQ ID NO: 17638 - RNA, 327 nt, synthetic construct
  misc_feature 1..327: note = derived and/or modified sequence opt2 from anti-HIV_119-099536_VR-Chain
  source 1..327: mol_type = other RNA
gagctcacccagcccccctccgtctccgccgcctccggccagaacgtcaacatctcctgctccggcggctcctccaacatcggctccaactacgtctcctggtaccagcagttccccggcaccgcccccaagctcctcatctacgagaccaacaagcgcccctccggcatccccgaccgcttctccggctccaagtccggcgcctccgccaccctcgccatcaccggcctccagaccggcgacgaggccgactactactgcgccacctgggccgactccctcaactccgcccgcgtcttcggcaccggcaccaaggtcaccgtcctc

SEQ ID NO: 17639 - RNA, 333 nt, synthetic construct
  misc_feature 1..333: note = derived and/or modified sequence opt2 from anti-HIV_119-098907_VR-Chain
  source 1..333: mol_type = other RNA
cagtccgtcctcacccagcccccctccgtctccgccacccccggccagaaggtcaccatctcctgctccggctccaactccaacatcggcgacaagtacgtctcctggtaccagcacttccccggcaccgcccccaagctcctcgtctacgagacctaccgccgcccctccggcatccccgaccgcttctccggctccaagtccggcacctccgccaccctcgccatcaccggcctccagaccggcgacgaggccgactactactgcaccatctggggcgtccgcaagggcgtcggcgccgtcttcggcaccggcaccaaggtcatcgtcctc

SEQ ID NO: 17640 - RNA, 324 nt, synthetic construct
  misc_feature 1..324: note = derived and/or modified sequence opt2 from anti-HIV_119-098555_VR-Chain
  source 1..324: mol_type = other RNA
cagtccgtcctcacccagcccccctccgtctccgccgcccccggccagaacgtcaccatctcctgctccggctccgcctccaacatcggcaagaacttcgtctcctggtaccagcagctccccggcaccgcccccaagctcctcatctacggctccaacaaccgcccctccggcgtccccgaccgcttctccggctccaagtccggcacctccgcctccctcgccatcaccggcctccagaccggcgacgaggccgactactactgcgagacctgggacggctccggcgccgtcttcggcaccggcaccaaggtcaccgtcctc

SEQ ID NO: 17641 - RNA, 324 nt, synthetic construct
  misc_feature 1..324: note = derived and/or modified sequence opt2 from anti-HIV_119-097828_VR-Chain
  source 1..324: mol_type = other RNA
cagtccgtcctcacccagcccccctccgtctccgccgcccccggccagaaggtcaccatctcctgctccggctcctcctccaacatcggcaagaactacgtctcctggtaccagctcctccccggcaccgccccccgcctcgtcatctacgagaacgacgagcgcccctccggcacccccgaccgcttctccggctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17642 - RNA, 324 nt, synthetic construct
  misc_feature 1..324: note = derived and/or modified sequence opt2 from anti-HIV_119-096480_VR-Chain
  source 1..324: mol_type = other RNA
cagtccgtcctcacccagcccccctccgtctccggcgcccccggccagcgcatcaccatctcctgctccggctccacctccaacatcggccagaactacgtctcctggtaccagcagctccccggcaccgcccccaagctcctcatctccgacaacaaccgccgcccctcctggacccccgaccgcttctccggctccaagtccggcacctccgccaccctcgccatcaccggcctccagaccggcgacgaggccgactactactgcgagacctgggacggctccggcggcgtcttcggccccggcacccgcgtcaccgtcctc

SEQ ID NO: 17643 - RNA, 324 nt, synthetic construct
  misc_feature 1..324: note = derived and/or modified sequence opt2 from anti-HIV_119-095664_VR-Chain
  source 1..324: mol_type = other RNA
cagtccgtcctcacccagcccccctccgtctccgccgcccccggccagaaggtcaccatctcctgctccggcggcgccgccaacatcggcaagaactccgtctcctggtaccagcagctccccggcaccgcccccaagctcctcatctacgacaacaaccgccgcccctccggcacccccgaccgcttctccggctccaagtccggcacctccgccaccctcgccatctccggcctccagaccggcgacgaggccgactactactgcgagacctggcacggctccggcggcgtcttcggcaccggcaccaaggtcaccgtcctc

SEQ ID NO: 17644 - RNA, 321 nt, synthetic construct
  misc_feature 1..321: note = derived and/or modified sequence opt2 from anti-HIV_119-095212_VR-Chain
  source 1..321: mol_type = other RNA
cagtccgtcctcacccagcccccctccgtctccgccgcccccggccagaaggtcaccatctcctgctccggctccacctccaacatcggcaagtccgacgtcttctggtaccagcagctccccggcaccgcccccaagctcctcatctccgagacctcccgccgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17645 - RNA, 333 nt, synthetic construct
  misc_feature 1..333: note = derived and/or modified sequence opt2 from anti-HIV_119-094773_VR-Chain
  source 1..333: mol_type = other RNA
cagtccgtcctcacccagtcccccaccgtctccgccgcccccggccagaccgtcaccatctcctgctccggcggcacctccaacgtcggcaagaacttcgtctcctggtaccagcagttcccccgcaccgcccccaagctcctcatctacgagaacaacaagcgcccctccggcatccccgaccgcttctccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17646 - RNA, 324 nt, synthetic construct
  misc_feature 1..324: note = derived and/or modified sequence opt2 from anti-HIV_119-094508_VR-Chain
  source 1..324: mol_type = other RNA
cagtccgtcctcacccagcccccctccgtctccgccacccccggccagcgcgtcaccgtctcctgctccggctcctcctccaacatcggcaaccactacgtctcctggtaccagcaggtccccggcaccgcccccaagctcctcatctccgagaactcccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17647 - RNA, 324 nt, synthetic construct
  misc_feature 1..324: note = derived and/or modified sequence opt2 from anti-HIV_119-093795_VR-Chain
  source 1..324: mol_type = other RNA
cagtccgtcctcacccagcccccctccgtctccgccgcccccggccagaaggtcaccatctcctgctccggctcctcctccaacatcggcaacaactacgtctcctggtaccagtacctccccggcaccgcccccaagctcctcatctccgagaacaaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17648 - RNA, 321 nt, synthetic construct
  misc_feature 1..321: note = derived and/or modified sequence opt2 from anti-HIV_119-093732_VR-Chain
  source 1..321: mol_type = other RNA
cagtccgtcctcacccagcccccctccgtctccgccgccgccggccagaacgtcaacatctcctgctccggccgcaagtccaacgtcggcggcaactacgtctcctggtaccagcagttccccggcaccgcccccaagctcctcatctacgaggacaacaagcgcccctcctggatccccgaccgcttcaccgcctcccgctccggcacctccgccaccctcggcatcaccggcctccagaccggcgacgaggccgactacttctgctccacctggtccggctccctcaacttcggcaccggcacccgcgtcaccgtcctc

SEQ ID NO: 17649 - RNA, 333 nt, synthetic construct
  misc_feature 1..333: note = derived and/or modified sequence opt2 from anti-HIV_119-092903_VR-Chain
  source 1..333: mol_type = other RNA
cagtccgtcctcacccagcccccctccgtctccgccgccccccgccagaaggtcaccatctcctgctccggctcctcctccaacatcggcaaccactacgtctcctggtaccagcagctccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcgccacctgggccccccgcctcaactccgcccgcgtcttcggcaacggcaccatggtcaccgtcctc

SEQ ID NO: 17650 - RNA, 333 nt, synthetic construct
  misc_feature 1..333: note = derived and/or modified sequence opt2 from anti-HIV_119-092284_VR-Chain
  source 1..333: mol_type = other RNA
cagtccgtcctcacccagcccccctccgtctccggcgcccccggccagcgcgtcaccatctcctgcaccggctcctcctccaacatcggcggctacgacgtccactggtaccagcaggtccccggcaccgcccccaagctcctcctctacgagaacgaccgccgcccctccggcatccccgaccgcttctccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17651 - RNA, 333 nt, synthetic construct
  misc_feature 1..333: note = derived and/or modified sequence opt2 from anti-HIV_119-091586_VR-Chain
  source 1..333: mol_type = other RNA
cagtccgtcctcacccagcccccctccatgtccgccgcccccggccagcgcgtcaccatctcctgctccggcacctcctccgacatcggccgcaactacgtctcctggtaccagcagttccccggcgccgcccccaaggtcctcatctacgagaactccaaccgcccctccggcatccccgaccgcttctccggctccaagtccggcacctccgccaccctcgccatctccggcctccagaccggcgacgaggccgactactgctgcgccgtctggggcgtccgccgcggcgccggcgccgtcttcggcgccggcaccaaggtcaccgtcctc

SEQ ID NO: 17652 - RNA, 333 nt, synthetic construct
  misc_feature 1..333: note = derived and/or modified sequence opt2 from anti-HIV_119-091023_VR-Chain
  source 1..333: mol_type = other RNA
cagtccgtcctcacccagcccccctccgtctccgccgcccccggccagcgcgtcaccatctcctgctccggctccacctccaacatcggcaacaacttcgtctcctggtaccaccacgtccccggcaccgcccccaagctcctcatctacgacaacgtcaagcgccccaccaacgtccccgaccgcttctccggctccaagtccggcacctccgccaccctcgccatctccggcctccagaccggcgacgaggccgactactggtgcgccgtctggggcgtccgccgcggcgccggcgccgtcttcggcgccggcaccaaggtcaccgtcctc

SEQ ID NO: 17653 - RNA, 333 nt, synthetic construct
  misc_feature 1..333: note = derived and/or modified sequence opt2 from anti-HIV_119-090334_VR-Chain
  source 1..333: mol_type = other RNA
cagtccgtcctcacccagcccccctccgtctccggcgcccccggccagcgcgtcaccatctcctgcaccggctccgcctccaacatcggcgactccgacgtccactggtaccagcagctccccggcaccgcccccaagctcctcatcttcgacaacgacaagcgcccctccggcatccccgaccgcttctccggctccaagtccggcacctccgccaccctcgccatcaccggcctccagtccggcgacgaggccgactactactgcgccgtctggggcgtccgccagggcgccggcgccgtcttcggcaccggcaccaaggtcaccgtcctc

SEQ ID NO: 17654 - RNA, 333 nt, synthetic construct
  misc_feature 1..333: note = derived and/or modified sequence opt2 from anti-HIV_119-088694_VR-Chain
  source 1..333: mol_type = other RNA
cagtccgtcctcacccagcccccctccgtctccgccgcccccggccagaaggtcaccatctcctgctccggctcctcctccaacatccccatcaacggcgtctcctggtaccagcagttccccggcaccgcccccaagctcctcgtctacgagacctaccgccgcccctccggcatccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17655 - RNA, 333 nt, synthetic construct
  misc_feature 1..333: note = derived and/or modified sequence opt2 from anti-HIV_119-088499_VR-Chain
  source 1..333: mol_type = other RNA
cagtccgtcctcacccagcccccctccgtctccgccgcccccggccagaaggtcaccatctcctgctccggctccaactcctacatcggcaacaagtacgtctcctggtaccagcagttccccggcaccgcccccaagctcctcatctacgagaccaacaagcgcccctccggcatccccgaccgcttctccggctccaagtccggcacctccgccaccctcgccatcaccggcctccagaccggcgacgaggccgactactactgcgccacctgggccccccgcctcaactccgcccgcgtcttcggcaacggcaccatggtcaccgtcctc

SEQ ID NO: 17656 - RNA, 333 nt, synthetic construct
  misc_feature 1..333: note = derived and/or modified sequence opt2 from anti-HIV_119-088298_VR-Chain
  source 1..333: mol_type = other RNA
cagtccgtcctcacccagcccccctccgtctccgccgcccccaaggagaaggtcaccatctcctgctccggcggcacctccaacatcggccgcaactacgtctcctggtaccagcaggtccccggcaccgcccccaagctcctcatctacgagaacaacaagcgcccctccggcatccccgaccgcttctccggctccaagtccggcacctccgccaccctcgtcatcaccggcctccagaccggcgacgaggccgacttctactgcggcacctggggcggctccctccgcaccggcggcgtcctcggcaccggcacccgcgtcaccgtcctc

SEQ ID NO: 17657 - RNA, 324 nt, synthetic construct
  misc_feature 1..324: note = derived and/or modified sequence opt2 from anti-HIV_119-087488_VR-Chain
  source 1..324: mol_type = other RNA
cagtccgtcctcacccagcccccctccgtctccgccgcccccggccagaaggtcaccatcttctgctccggccgctactccaacatcgagtccaactacgtctcctggtaccagcagctccccggcaccgcccccaagctcctcatccacgagaacaaccgccgcccctccggcacccccgaccgcttctccggctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17658 - RNA, 333 nt, synthetic construct
  misc_feature 1..333: note = derived and/or modified sequence opt2 from anti-HIV_119-087423_VR-Chain
  source 1..333: mol_type = other RNA
cagtccgtcctcacccagcccccctccgtctccgccgcccccggccagaaggtcaccatctcctgctccgcctcctcctccaacatcggcaacaactacgtctcctggtaccagcagctccccgccaccgcccccaagctcctcatctacgacaccgacaagcgcccctccggcatccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17659 - RNA, 324 nt, synthetic construct
  misc_feature 1..324: note = derived and/or modified sequence opt2 from anti-HIV_119-087371_VR-Chain
  source 1..324: mol_type = other RNA
cagtccgtcctcacccagcccccctccctctccgccgcccccggccagcgcgtcaccatctcctgctccggcggcgcctccaacatcggcaagaactccgtctcctggtacgtccaggtccccggcaccgcccccaagctcctcatctacgagaacaaccagcgcccctccggcatctccgaccgcttctccggctccaagtccggctcctccgccaccctcggcatcaccggcctccagaccgccgacgaggccgactactactgcgagacctgggacggctccggcggcgtcttcggcaccggcaccaaggtcaccgtcctc

SEQ ID NO: 17660 - RNA, 321 nt, synthetic construct
  misc_feature 1..321: note = derived and/or modified sequence opt2 from anti-HIV_119-087279_VR-Chain
  source 1..321: mol_type = other RNA
cagtccgtcctcacccagcccccctccgtctccgccgcccccggccagaaggtcaccatctcctgctccggctcctcctccaacatcggcaagaactacgtctcctggtaccagcagttccccggcaccgcccccaagctcctcatgtacgagaacaacaagcgcccctccggcgtccccgaccgcttctccggctccaagtccggcacctccgccaccctcgacatctccggcctccagaccggcgacgaggccgactactactgctccacctggtccggctccctcaacttcggcaccggcacccgcgtcaccgtcctc

SEQ ID NO: 17661 - RNA, 324 nt, synthetic construct
  misc_feature 1..324: note = derived and/or modified sequence opt2 from anti-HIV_119-087146_VR-Chain
  source 1..324: mol_type = other RNA
cagtccgtcctcacccagcccccctccgtctccgccgcccccggccagaaggtcaccatctcctgctccggctcctcctccaacatcggcaagaactccgtctcctggtaccagcagttccccggcaccgcccccaagctcctcatctacgagaacaacaagcgcccctccggcatccccgaccgcttctccggctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17662 - RNA, 324 nt, synthetic construct
  misc_feature 1..324: note = derived and/or modified sequence opt2 from anti-HIV_119-087048_VR-Chain
  source 1..324: mol_type = other RNA
cagttcgtcctcacccagcccccctccgtctccgccgccccccgccagaaggtcatcatctcctgctccggctcctcctccaacatcggcaagaactacgtctcctggtaccagcagctccccggcaccgcccccaagctcctcatctacgacaacgacaagcgcccctccggcatctccgaccgcttctccgcctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17663 - RNA, 321 nt, synthetic construct
  misc_feature 1..321: note = derived and/or modified sequence opt2 from anti-HIV_119-085802_VR-Chain
  source 1..321: mol_type = other RNA
cagtccatcctcacccagcccccctccgtctccgccgcccccggccagcgcgtcaccatcccctgcttcggcggccactccaacatcggctccaactacgtctcctggtaccagcacctccccggcaccgcccccaagctcctcatcttcgagaacaacaagcgcccctccggcatccccgaccgcttctccggcgccaagtccggcacctccgccaccctcgccatcaccggcctccagaccggcgacgaggccgactacttctgcgccacctggtccggcggcctcaacttcggcaccggcaccaaggtcaccgtcctc

SEQ ID NO: 17664 - RNA, 324 nt, synthetic construct
  misc_feature 1..324: note = derived and/or modified sequence opt2 from anti-HIV_119-085784_VR-Chain
  source 1..324: mol_type = other RNA
cagtccttcctcacccagcccccctccgtctccgccgcccccggccagaaggtcaccatctcctgctccggctccaactccaacatcggcaacaactacgtctcctggtaccagtacctccccggcaccgcccccaagctcctcatctacgagaacgaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17665 - RNA, 333 nt, synthetic construct
  misc_feature 1..333: note = derived and/or modified sequence opt2 from anti-HIV_119-085370_VR-Chain
  source 1..333: mol_type = other RNA
cagtccgtcctcacccagcccccctccgtctccgccgcccccggccagaccgtcaccatctcctgctccggctcctcctccaacatcggcaacacctacgtctcctggtaccagcacctccccggcaccgcccccaagctcctcatctacgacaacaacatccgcccctccggcatccccgaccgcttctccgcctccaagtccggcacctccgccaccctcgccatcaccggcctccagaccggcgacgaggccgactactactgcgccacctgggccccctccctcaactccgcccgcgtcttcggctccggcacccgcgtcgccgtcctc

SEQ ID NO: 17666 - RNA, 321 nt, synthetic construct
  misc_feature 1..321: note = derived and/or modified sequence opt2 from anti-HIV_119-085276_VR-Chain
  source 1..321: mol_type = other RNA
cagtccatcctcacccagcccccctccgtctccgccgcccccggccagcgcgtcaccatctcctgctccggctcctcctccaacatcggcaacaactacgtctcctggtaccagcacgtccccggcaccgcccccaagctcctcatctacgagaacaaccgccgcccctccggcacccccgaccgcttctccggcgccaagtccggcacctccgccaccctcgccatcaccggcctccagaccggcgacgaggccgactacttctgctccacctggtccggctccctcaacttcggcaccggcaccaaggtcaccgtcctc

SEQ ID NO: 17667 - RNA, 333 nt, synthetic construct
  misc_feature 1..333: note = derived and/or modified sequence opt2 from anti-HIV_119-084885_VR-Chain
  source 1..333: mol_type = other RNA
cagtccgtcctcacccagcccccctccgtctccgccgcccccggcgagaaggtcaccatctcctgctccggctcctcctccaagatcggcaacaacttcgtctcctggtaccagcaggtccccggcaccgcccccaagctcctcgtctacgagtcctaccgccgcccctccggcatccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17668 - RNA, 333 nt, synthetic construct
  misc_feature 1..333: note = derived and/or modified sequence opt2 from anti-HIV_119-084874_VR-Chain
  source 1..333: mol_type = other RNA
cagtccgtcctcacccagcccccctccgtctccggcgccccccgccagcgcgtcaccatctcctgctccggctccgcctccaacatcggcaagaactccgtctcctggtaccagcaggtccccggcaccgcccccaagctcctcatctacgagaacaacaagcgcccctccggcatccccgaccgcttctccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17669 - RNA, 333 nt, synthetic construct
  misc_feature 1..333: note = derived and/or modified sequence opt2 from anti-HIV_119-084691_VR-Chain
  source 1..333: mol_type = other RNA
cagtccgtcctcacccagcccccctccgtctccgccgcccccggccagaaggtcgtcatctcctgctccggctcctcctccatcatcgagaagaactccatctcctggtaccagcagggccccggcgccgcccccaagctcctcatctacgagaacgacaagcgcccctccggcatccccgaccgcttctccggctccaagtccgccacctccgccaccctcgccatcgtcggcctccagaccggcgacgaggccgactactgctgcgccgtctggggcgtccgccgcggcgccggcgccgtcttcggcgccggcaccaaggtcaccgtcctc

SEQ ID NO: 17670 - RNA, 324 nt, synthetic construct
  misc_feature 1..324: note = derived and/or modified sequence opt2 from anti-HIV_119-083793_VR-Chain
  source 1..324: mol_type = other RNA
cagtccgtcctcacccagcccccctccgtctccgccgcccccggccagaaggtcaccatctcctgctccggctcctcctccaacatcggcaagaactccgtctcctggtaccagcagctccccgccaccgcccccaagctcctcatctacgagtccaacaagcgcccctccggcatccccgaccgcttctccggctccaagtccggcacctccgccaccctcgccatcaccggcctccagaccggcgacgaggccgactactactgcgccacctgggacggccgcgtctccgtcatcggcaccggcaccaaggtcaccgtcctc

SEQ ID NO: 17671 - RNA, 324 nt, synthetic construct
  misc_feature 1..324: note = derived and/or modified sequence opt2 from anti-HIV_119-083163_VR-Chain
  source 1..324: mol_type = other RNA
cagtccgtcctcacccagcccccctccgtctccggcgcccccggccagcgcgtcatcatctcctgcaccggctcctcctccaacatctggggctacgacgtccagtggtaccagcagctccccggcaccgcccccaagctcctcctctacgagaacgaccgccgcccctccggcacccccgaccgcttctccggctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17672 - RNA, 333 nt, synthetic construct
  misc_feature 1..333: note = derived and/or modified sequence opt2 from anti-HIV_119-082331_VR-Chain
  source 1..333: mol_type = other RNA
cagtccgtcctcacccagcccccctccatctccgccgcccccggccagaaggtcaccatctcctgctccggcggctcctccaacatcggcgccaactacgtctcctggtaccagcacctccccggcaccgcccccaagctcctcatctacgagaccaacaagcgcccctccggcatccccgaccgcttctccggctcccagtccggcacctccgccaccctcgtcatcaccggcctccagaccggcgacgaggccgacttctactgcggcacctggggcggctccctccgcgccggcggcgtcatcggcaccggcacccgcgtcaccgtcctc

SEQ ID NO: 17673 - RNA, 324 nt, synthetic construct
  misc_feature 1..324: note = derived and/or modified sequence opt2 from anti-HIV_119-082070_VR-Chain
  source 1..324: mol_type = other RNA
cagtccgtcctcacccagcccccctccgtctccgccgcccccggccagaaggtcgtcatctcctgctccggctcctcctccatcatcgagaagaactccatctcctggtaccagcagggccccggcgccgcccccaagctcctcatctacgagaacgaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17674 - RNA, 333 nt, synthetic construct
  misc_feature 1..333: note = derived and/or modified sequence opt2 from anti-HIV_119-081512_VR-Chain
  source 1..333: mol_type = other RNA
cagtccgtcctcacccagcccccctccgtctccgccgcccccggccagaacgtcaccttctcctgctccggctccaactccaacatcggcgacaactacgtctcctggtaccagcagatccccggcaccgcccccaagctcgtcatctacgacaacaacaagcgcccctccggcatccccgaccgcttctccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17675 - RNA, 333 nt, synthetic construct
  misc_feature 1..333: note = derived and/or modified sequence opt2 from anti-HIV_119-080816_VR-Chain
  source 1..333: mol_type = other RNA
cagctcgtcctcacccagcccccctccgcctccggcacccccggccagcgcgtcaccatctcctgctccggctcctcctccaacatcggctccaacttcgtctcctggtaccagcagcgccccggcaccgcccccaagctcctcatctacgagaccaacaagcgcccctccggcatccccgaccgcttctccggctccaagtccggcacctccgccaccctcgccatcaccggcctccagaccggcgacgaggccgactactactgcgccacctgggccccccgcctcaactccgcccgcgtcttcggcaacggcaccatggtcaccgtcctc

SEQ ID NO: 17676 - RNA, 333 nt, synthetic construct
  misc_feature 1..333: note = derived and/or modified sequence opt2 from anti-HIV_119-079302_VR-Chain
  source 1..333: mol_type = other RNA
cagtccgtcctcacccagcccccctccgtctccgccgcccccggccagaaggtcaccatctcctgctccggctcctcctcctacatcggcaacaagtacgtctcctggtaccagcagttccccggcaccgcccccaagctcctcatctacgagaacaacaagcgcctctccggcatccccgaccgcttctccgcctccaagtccgccacctccgccaccctcgccatctccggcctccagaccggcgacgaggccgacttctactgcggcacctgggacggctccctccgcaccggcggcgtcatcggcaccggcacccgcgtcaccgtcctc

SEQ ID NO: 17677 - RNA, 327 nt, synthetic construct
  misc_feature 1..327: note = derived and/or modified sequence opt2 from anti-HIV_119-079292_VR-Chain
  source 1..327: mol_type = other RNA
cagtccgtcctcacccagcccccctccgtctccgccgcccccggccagaaggtcaccatctcctgctccggctccaactccaacatcggcaacaactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccaactactactgcggcacctgggacacctccctctccggcgtcttcggcaccggcaccgaggtcatcgtcctc

SEQ ID NO: 17678 - RNA, 321 nt, synthetic construct
  misc_feature 1..321: note = derived and/or modified sequence opt2 from anti-HIV_119-079289_VR-Chain
  source 1..321: mol_type = other RNA
cagtccgccctcacccagcccccctccgtctccgccgcccccggccagcgcgtcaccatctcctgctccggcaacaactccaacatcggcaacaacttcgtctcctggtaccagctcctccccggcaccgcccccaagctcctcatctacgagaacaacaagcgctcctccggcatccccgaccgcttctccggctccaagtccggcacctccgccaccctcggcatcaccggcctccagaccggcgacgaggccgactacttctgctccacctggtccggctccctcaacttcggcaccggcacccgcgtcaccgtcctc

SEQ ID NO: 17679 - RNA, 324 nt, synthetic construct
  misc_feature 1..324: note = derived and/or modified sequence opt2 from anti-HIV_119-078935_VR-Chain
  source 1..324: mol_type = other RNA
cagtccgtcctcacccagcccccctccgtctccgccgcccccggccagcgcgtcaccatctcctgctccggcacctccgccaacatcgagaactactacgtctcctggtaccagcagctccccggcaccgcccccaagctcatcatctacgacgacaacaagcgcccctccggcatcccccagcgcttctccggctccaagtccggcacctccgccaccctcggcatcaccggcctccagaccggcgacgaggccgagtactactgcgagacctgggacggctccggcggcgtcttcggcaccggcaccaaggtcaccgtcctc

SEQ ID NO: 17680 - RNA, 324 nt, synthetic construct
  misc_feature 1..324: note = derived and/or modified sequence opt2 from anti-HIV_119-078702_VR-Chain
  source 1..324: mol_type = other RNA
cagtccgtcctcacccagcccccctccgtctccgccgcccccggccagaaggtcaccatctcctgctccggctcctcctccgtcttcggcaagaactacgtctcctggtaccagcacctccccggcaccgcccccaagctcctcatctacgagaacaccaagcgcccctccggcatccccgaccgcttctccggctccaagtccggcacctccgccaccctcgccatcaccggcctccagaccggcgacgaggccgactactactgcgagacctgggacggctccggcggcgtcttcggctccggcaccaaggtcaccgtcctc

SEQ ID NO: 17681 - RNA, 324 nt, synthetic construct
  misc_feature 1..324: note = derived and/or modified sequence opt2 from anti-HIV_119-078593_VR-Chain
  source 1..324: mol_type = other RNA
cagtccttcctcacccagcccccctccgtctccgccgcccccggccagaaggtcaccatctcctgctccggctccaactccaacatcggcaacaactacgtctcctggtaccagcaggtccccggcaccgcccccaagctcctcatctacgagaacaacaagcgcccctccggcatccccgaccgcttctccggctccaagtccggcacctccgccaccctcgtcatcaccggcctccacaccggcgacgaggccgactactactgcgagacctgggacggctccggcggcgtcttcggcaccggctccaacgtcaccctcctc

SEQ ID NO: 17682 - RNA, 333 nt, synthetic construct
  misc_feature 1..333: note = derived and/or modified sequence opt2 from anti-HIV_119-077708_VR-Chain
  source 1..333: mol_type = other RNA
cagtccgtcctcacccagcccccctccctctccgccgcccccggccagaaggtcaccatctcctgctccggcaccacctccaacatcggcaacaactacgtctcctggtaccagcacctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcaccgtctggggcgtccgcaagggcgtcggcgccgtcttcggcaccggcaccaaggtcaccgtcctc

SEQ ID NO: 17683 - RNA, 321 nt, synthetic construct
  misc_feature 1..321: note = derived and/or modified sequence opt2 from anti-HIV_119-076904_VR-Chain
  source 1..321: mol_type = other RNA
cagtccgtcctcacccagcccccctccgtctccgccgcccccggccagaaggtcaccatctcctgctcccgctcctcctcccacatcgagaactcctacgtctcctggtaccagcacctccccggcaccgcccccaagctcctcatctacgagaacaacaagcgcccctccggcatccccgaccgcttctccggctccaagtccggcacctccgccaccctcggcatctccggcctccagaccggcgacgaggccgactacttctgctccacctggtccggctccctcaacttcggcaccggcacccgcgtcaccgtcctc

SEQ ID NO: 17684 - RNA, 324 nt, synthetic construct
  misc_feature 1..324: note = derived and/or modified sequence opt2 from anti-HIV_119-075862_VR-Chain
  source 1..324: mol_type = other RNA
cagtccgtcctcacccagcccccctccatctccgccgcccccggccagaaggtcaccatctcctgctccggctccgcctccaacatcggcaagaactccgtctcctggtaccagcagttccccggcaccgcccccaagctcctcatctacgagaacaaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17685 - RNA, 333 nt, synthetic construct
  misc_feature 1..333: note = derived and/or modified sequence opt2 from anti-HIV_119-075465_VR-Chain
  source 1..333: mol_type = other RNA
cagtccgtcctcacccagcccccctccgtctccgccgcccccggccagaaggtcgtcatctcctgctccggctcctcctccatcatcggcaacaactacgtctcctggtaccagcagctccccggcaccgcccccaagctcctcatctacgagaacaaccgccgcccctccggcatccccgaccgcttctccggctccaagtccggcacctccgccaccctcgccatctccggcctccagaccggcgacgaggccgactactgctgcgccgtctggggcgtccgccgcggcgccggcgccgtcttcggcgccggcaccaaggtcaccgtcctc

SEQ ID NO: 17686 - RNA, 330 nt, synthetic construct
  misc_feature 1..330: note = derived and/or modified sequence opt2 from anti-HIV_119-074822_VR-Chain
  source 1..330: mol_type = other RNA
tccgtcctcacccagcccccctccgtctccgccgcccccggccagaacatcaccatctcctgctccggcggctcctccaacatcgccaagaactacatctcctggtaccagcacctccccggcaccgcccccaagatcgtcatctacgacaacgacaagcgccccctcggcatccccgaccgcttctccgcctccaagtccggcacctccgccaccctcggcatcaccggcctccagaccggcgacgaggccgactactactgcgccgtctggggcgtccgccgcggcgtcggcgccgtcttcggcgccggcaccaaggtcatcgtcctc

SEQ ID NO: 17687 - RNA, 333 nt, synthetic construct
  misc_feature 1..333: note = derived and/or modified sequence opt2 from anti-HIV_119-074629_VR-Chain
  source 1..333: mol_type = other RNA
cagtccgtcctcacccagcccccctccgagtccgccgcccccggccagaaggtcaccatctcctgctccggcggcacctccaacatcggcaacaactacgtctcctggtaccgccgcctccccggcaccgcccccaagctcctcatctacgagaacaaccgccgcccctccggcatccccgaccgcttctccggctccaagtccggcacctccgccaccctcgccatctccggcctccagaccggcgacgaggccgactactgctgcgccgtctggggcgtccgccgcggcgccggcgccgtcttcggcgccggcaccaaggtcaccgtcctc

SEQ ID NO: 17688 - RNA, 324 nt, synthetic construct
  misc_feature 1..324: note = derived and/or modified sequence opt2 from anti-HIV_119-074500_VR-Chain
  source 1..324: mol_type = other RNA
cagtccgtcctcacccagcccccctccgtctccgccgcccccggccagaaggtcaccatgtcctgctccggctcctcctccaacatcggcaacaactacgtctcctggtaccagtacctccccggcaccgcccccaagctcctcatctacgagaacgaccgccgcccctccggcatccccgaccgcttctccgcctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17689 - RNA, 333 nt, synthetic construct
  misc_feature 1..333: note = derived and/or modified sequence opt2 from anti-HIV_119-073911_VR-Chain
  source 1..333: mol_type = other RNA
cagtccgtcctcacccagcccccctccgtctccgccgcccccggccagcgcgtcaccatctcctgctccggctcctcctccaacatcgagaacaactacgtctcctggtaccagcacctccccggcaccgcccccaagctcctcgtctacgacgacaacaagcgcccctccggcatcccccaccgcttctccgcctccaagtccggcacctccgccaccctcgccatcaccggcctccagaccggcgacgaggccgactactactgcaccctctggggcgtccgcaagggcgtcggcgccgtcttcggcaccggcaccaaggtcaccgtcctc

SEQ ID NO: 17690 - RNA, 324 nt, synthetic construct
  misc_feature 1..324: note = derived and/or modified sequence opt2 from anti-HIV_119-072765_VR-Chain
  source 1..324: mol_type = other RNA
cagtccgtcctcacccagcccccctccgtctccgccgcccccggccagaaggtcaccatctcctgctccggcaactcctccaacatcggcaacaacttcgtctcctggtaccagcaggtccccggcaccgcccccaagctcctcgtctacgagacctaccgccgcccctccggcacccccgaccgcttctccggctccaagtccggcacctccgccaccctcgccatctccggcctccagaccggcgacgaggccgactactactgcggcacctgggacggctccggcggcgtcttcggcaccggcaccaaggtcaccgtcctc

SEQ ID NO: 17691 - RNA, 333 nt, synthetic construct
  misc_feature 1..333: note = derived and/or modified sequence opt2 from anti-HIV_119-072313_VR-Chain
  source 1..333: mol_type = other RNA
cagttcgtcctcacccagcccccctccgtctccgccgcccccggccagaaggtcaccatctcctgctccgcctcctcctccatcatcggcaagaactacgtctcctggtaccagcagttccccggcaccgcccccaagctcctcatctacgaggacaacaagcgcccctccggcatccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17692 - RNA, 333 nt, synthetic construct
  misc_feature 1..333: note = derived and/or modified sequence opt2 from anti-HIV_119-072280_VR-Chain
  source 1..333: mol_type = other RNA
cagtccgtcctcacccagcccccctccgtctccgccgcccccggccagaaggtctccatctcctgctccggctccgactccaacctcggcgacaactacgtctcctggtaccagcagttccccggcaccgcccccaagctcctcatccacgacaacaacaagcgcccctccggcacccccgaccgcttctccggctccaagtccggcacctccgccaccctcgccatcaccggcctccagaccggcgacgaggccgactactactgcgccacctgggccccccgcctcaactccgcccgcgtcttcggcaacggcaccatggtcaccgtcctc

SEQ ID NO: 17693 - RNA, 333 nt, synthetic construct
  misc_feature 1..333: note = derived and/or modified sequence opt2 from anti-HIV_119-071693_VR-Chain
  source 1..333: mol_type = other RNA
cagtccgtcctcacccagcccccctccgtctccgccgcccccggccagaaggtcgtcatctcctgctccggctcctcctccatcatcgagaagaactccatctcctggtaccagcagggccccggcgccgcccccaagctcctcatctacgagaacgacaagcgcccctccggcatccccgaccgcttctccggctccaagtccggcacctccgccaccctcgccatcaccggcctccagaccggcgacgaggccgactactactgcaccatctggggcgtccgcaagggcgtcggcgccgtcttcggcaccggcaccaaggtcaccgtcctc

SEQ ID NO: 17694 - RNA, 321 nt, synthetic construct
  misc_feature 1..321: note = derived and/or modified sequence opt2 from anti-HIV_119-071353_VR-Chain
  source 1..321: mol_type = other RNA
cagtccgtcctcacccagcccccctccgcctccgccgcccccggccagaaggtcaccatctcctgctccggctccaactccaacatcggcaacaacttcgtctcctggtaccagctcttccccggcaccgcccccaagctcctcatcttcgagaacaacaagcgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17695 - RNA, 324 nt, synthetic construct
  misc_feature 1..324: note = derived and/or modified sequence opt2 from anti-HIV_119-069711_VR-Chain
  source 1..324: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgacaacaacaaccgcccctccggcgtccccgaccgcttctccggctccaagtccggcacctccgccaccctcgccatcaccggcctccagaccggcgacgaggccgactactactgcgagacctgggacgactccggcggcgtcttcggcaccggcaccaaggtcaccgtcctc

SEQ ID NO: 17696 - RNA, 333 nt, synthetic construct
  misc_feature 1..333: note = derived and/or modified sequence opt2 from anti-HIV_119-069061_VR-Chain
  source 1..333: mol_type = other RNA
cagtccgtcctcacccagcccccctccgtctccgccgcccccggccagaaggtcaccatctcctgctccggctcctcctccaacatcggctccaactacgtctcctggtaccagcagctccccggcaccgcccccaagctcctcgtctacgacaacaacgagcgcccctccggcatccccgaccgcttctccggctccaagtccggcacctccgccaccctcgccatcaccggcctccagaccggcgacgaggccgactactactgcgccacctgggccccccgcctcaactccgcccgcgtcttcggcaacggcaccatggtcaccgtcctc

SEQ ID NO: 17697 - RNA, 324 nt, synthetic construct
  misc_feature 1..324: note = derived and/or modified sequence opt2 from anti-HIV_119-068202_VR-Chain
  source 1..324: mol_type = other RNA
cagtccgtcctcacccaggagccctccgtctccggcgcccccggccagcgcgtcaccatctcctgcaccggctccaactccaacatcggcggccacgacgtccactggtaccagcagctccccggcaccgcccccaagctcctcatctacgacaacgacaagcgcccctccggcatccccgaccgcttctccggctccaagtccgacacctccgcctccctcggcatcaccggcctccagaccggcgacgaggccgactactactgcgagacctgggacggctccggcggcgtcttcggcaccggcaccaaggtcaccgtcctc

SEQ ID NO: 17698 - RNA, 324 nt, synthetic construct
  misc_feature 1..324: note = derived and/or modified sequence opt2 from anti-HIV_119-068063_VR-Chain
  source 1..324: mol_type = other RNA
cagtccgccctcacccagcccccctccgcctccggctccctcggccagtccgtcaccatctcctgcaccggcacccgctccgacgtcggcaactactacgtctcctggtaccagcagctccccggcaccgcccccaagctcctcatctccgagaacaaccgccgcccctccggcacccccgaccgcttctccggctccaagtccggcacctccgccaccctcgccatctccggcctccagaccggcgacgaggccgactactactgcggcacctgggacggctccggcggcgtcttcggcaccggcaccaaggtcaccgtcctc

SEQ ID NO: 17699 - RNA, 333 nt, synthetic construct
  misc_feature 1..333: note = derived and/or modified sequence opt2 from anti-HIV_119-067980_VR-Chain
  source 1..333: mol_type = other RNA
cagtccgtcctcacccagcccccctccgtctccgccgcccccggccagaaggtcaccatctcctgctccggcaactcctccaacatcggcaacaacttcgtctcctggtaccagcaggtccccggcaccgcccccaagctcctcgtctacgagacctaccgccgcccctccggcatccccgaccgcttctccggctccaagtccggcacctccgccaccctcgccatcaccggcctccagaccggcgacgaggccgactaccactgcgccatctggggcgtccgcaagggcgtcggcgccgtcttcggcaccggcaccaaggtcaccgtcgtc

SEQ ID NO: 17700 - RNA, 324 nt, synthetic construct
  misc_feature 1..324: note = derived and/or modified sequence opt2 from anti-HIV_119-067866_VR-Chain
  source 1..324: mol_type = other RNA
cagtccgtcctcacccagcccccctccgtctccgccgcccccggccagaaggtcaccatctcctgctccggctccacctccaccatcggcaacaactacgtctcctggtaccagcacctccccggcaccgcccccaagctcctcatctacgacaacaacaagcgccccgccggcatccccgaccgcttcaccgcctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17701 - RNA, 321 nt, synthetic construct
  misc_feature 1..321: note = derived and/or modified sequence opt2 from anti-HIV_119-067756_VR-Chain
  source 1..321: mol_type = other RNA
cagtccgtcctcacccagcccccctccgtctccgccgcccccggccagaaggtcgtcatctcctgctccggctccacctccaacatcggcaagaacttcgtctcctggtaccagcagctccccggcaccgcccccaagctcctcatctacgagaactcccgccgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17702 - RNA, 321 nt, synthetic construct
  misc_feature 1..321: note = derived and/or modified sequence opt2 from anti-HIV_119-066859_VR-Chain
  source 1..321: mol_type = other RNA
cagtccgtcctcacccagcccccctccgtctccgccgcccccggccagaaggtcaccatcacctgctccggctccgcctccaacatcgagaacaactacgtctcctggtaccagcagttccccggccccgcccccaagctcctcatctacgagaacgacaagcgcccctccggcatccccgaccgcttctccggctccgcctccggcacctccgccaccctcgccatcaccggcctccagaccggcgacgaggccgactacttctgctccacctggtccggctccctcaacttcggcaccggcacccgcgtcaccgtcctc

SEQ ID NO: 17703 - RNA, 333 nt, synthetic construct
  misc_feature 1..333: note = derived and/or modified sequence opt2 from anti-HIV_119-065821_VR-Chain
  source 1..333: mol_type = other RNA
cagtccgtcctcacccagcccccctccgtctccgccacccccggccagcgcgtcaccgtctcctgctccggctcctcctccaacatcggcaaccactacgtctcctggtaccagcaggtccccggcaccgcccccaagctcctcatctacgacaactccaaccgcccctccggcatccccgaccgcttctccggctccaagtccggcacctccgccaccctcggcatcaccggcctccagaccggcgacgaggccgactactactgcaccgtctggggcgtccgcaagggcgtcggcgccgtcttcggcaccggcaccaaggtcaccgtcctc

SEQ ID NO: 17704 - RNA, 333 nt, synthetic construct
  misc_feature 1..333: note = derived and/or modified sequence opt2 from anti-HIV_119-065191_VR-Chain
  source 1..333: mol_type = other RNA
cagtccgtcctcacccagcccccctccgtctccgccgcccccggccagaaggtcaccatctcctgctccggcaacaactccaacatcggcaacaactacgtctcctggtaccagcagctccccggcaccgcccccaagctcctcatcttcgagaaccacaagcgcccctccggcatccccgaccgcttctccggctccaagtccggcacctccgccaccctcggcatcaccggcctccagtccggcgacgaggccgactactactgcgccacctgggccccccgcctcaactccgcccgcgtcttcggcaccggcaccaaggtcaccgtcctc

SEQ ID NO: 17705 - RNA, 333 nt, synthetic construct
  misc_feature 1..333: note = derived and/or modified sequence opt2 from anti-HIV_119-064667_VR-Chain
  source 1..333: mol_type = other RNA
cagtccgtcctcacccagcccccctccgtctccgccgcccccggccagaaggtcaccatctcctgctccggctccaactcctacatcggcaacaagtacgtctcctggtaccagcaggtccccggcaccgcccccaagctcctcatctacgagaacaacaagcgcccctccggcatccccgaccgcttctccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17706 - RNA, 324 nt, synthetic construct
  misc_feature 1..324: note = derived and/or modified sequence opt2 from anti-HIV_119-063791_VR-Chain
  source 1..324: mol_type = other RNA
cagtccgtcctcacccagcccccctccgtctccgccgcccccggccagaaggtccccatctcctgctccggcaactcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17707 - RNA, 333 nt, synthetic construct
  misc_feature 1..333: note = derived and/or modified sequence opt2 from anti-HIV_119-062989_VR-Chain
  source 1..333: mol_type = other RNA
cagtccgtcctcacccagcccccctccgtctccgccgcccccggccagcgcgtcaccatctcctgctccggctcctcctccaacatcggcaacaacttcgtctcctggtaccagcagttccccggcaccgtccccaagctcctcatctacgagaacaaccgccgcccctccggcatccccgaccgcttctccggctccaagtccggcacctccgccaccctcgccatcaccggcctccagaccggcgacgaggccgactactactgcgccgtctggggcgtccgccgcggcgtcggcgccgtcttcggcgccggcaccaaggtcatcgtcctc

SEQ ID NO: 17708 - RNA, 321 nt, synthetic construct
  misc_feature 1..321: note = derived and/or modified sequence opt2 from anti-HIV_119-062286_VR-Chain
  source 1..321: mol_type = other RNA
cagtccgtcctcacccagcccccctccgtctccgccgcccccggccagaaggtcaccatctcctgctccggctccgcctccaacatcggcaagaacttcgtctcctggtaccagcagctccccggcaccgcccccaagctcctcatctccgagaacaaccgccgcccctccggcacccccgaccgcttctccggctccaagtccggcgcctccgccaccctcgtcatctccggcctccagaccggcgacgaggccgactactactgcgccacctggtccggctccctctccatcggcaccggcaccaaggtcaccgtcctc

SEQ ID NO: 17709 - RNA, 321 nt, synthetic construct
  misc_feature 1..321: note = derived and/or modified sequence opt2 from anti-HIV_119-061416_VR-Chain
  source 1..321: mol_type = other RNA
cagtccgtcctcacccagcccccctccgtctccgccgcccccggccagaaggtcgtcatctcctgctccggctcctcctccatcttcgagaagaactccatctcctggtaccagcagggccccggcgccgcccccaagctcctcatctacgagaacgacaagcgccgctccggcatccccgaccgcttctccggctccaagtccgccacctccaccaccctcgccatcgtcggcctccagaccggcgacgaggccgactacttctgctccacctggtccggctccctcaacttcggcaccggcacccgcgtcaccgtcctc

SEQ ID NO: 17710 - RNA, 321 nt, synthetic construct
  misc_feature 1..321: note = derived and/or modified sequence opt2 from anti-HIV_119-061344_VR-Chain
  source 1..321: mol_type = other RNA
cagtccgtcctcacccagcccccctccgtctccgccgcccccggccagaaggtcaccatctcctgctccggctcctcctccgtcttcggcaagaactacgtctcctggtaccagcacctccccggcaccgcccccaagctcctcatctacgagaacaacaagcgcccctccggcatccccgaccgcttctccggcgccaagtccggcaccgccgccaccctcgccatcaccggcctccagaccggcgacgaggccgactactactgcgccacctggtccggctccctcaacttcggcaccggcaccaaggtcaccgtcctc

SEQ ID NO: 17711 - RNA, 324 nt, synthetic construct
  misc_feature 1..324: note = derived and/or modified sequence opt2 from anti-HIV_119-060240_VR-Chain
  source 1..324: mol_type = other RNA
cagtccgtcctcacccagcccccctccgagtacggcgcccccggccacaacgtcaccgtctcctgctccggcaccacctccaacatcgagaacaacttcgtctcctggtacctcatcgtccccggcaccgcccccaagctcctcatcttcgacaacgacaagcgcccctccggcatccccgaccgcttctccggctccaagtccggcacctccgccaccctcgccatcaccggcctccagaccggcgacgaggccgactactactgcgccacctgggacggccgcgtctccgtcatcggcaccggcaccaaggtcaccgtcctc

SEQ ID NO: 17712 - RNA, 333 nt, synthetic construct
  misc_feature 1..333: note = derived and/or modified sequence opt2 from anti-HIV_119-060184_VR-Chain
  source 1..333: mol_type = other RNA
cagtccgtcctcacccagcccccctccgtctccggcgcccccggccagcgcgtcaccatctcctgctccggctcctcctccaacatcggctccaacaccgtcaactggtaccagcagctccccggcaccgcccccaagctcctcatctacgacaacaacaagcgcccctccggcatccccgaccgcttctccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17713 - RNA, 321 nt, synthetic construct
  misc_feature 1..321: note = derived and/or modified sequence opt2 from anti-HIV_119-058035_VR-Chain
  source 1..321: mol_type = other RNA
cagtccgtcctcacccagcccccctccgtctccgccgcccccggccagaaggtcaccatctcctgctccggctccgcctccaacatcggcaagaacttcgtctcctggtaccagcagctccccggcaccgcccccaagctcctcatctacgagaacaaccgccgcccctccggcacccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17714 - RNA, 321 nt, synthetic construct
  misc_feature 1..321: note = derived and/or modified sequence opt2 from anti-HIV_119-057858_VR-Chain
  source 1..321: mol_type = other RNA
cagtccgtcctcacccagcccccctccgtctccgccgcccccggccagaacgtcaacatctcctgctccggcggctcctccaacatcggctccaactacgtctcctggtaccagcagttccccggcaccgcccccaagctcctcatctacgagaacaacaagcgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17715 - RNA, 324 nt, synthetic construct
  misc_feature 1..324: note = derived and/or modified sequence opt2 from anti-HIV_119-057473_VR-Chain
  source 1..324: mol_type = other RNA
cagtccgtcctcacccagcccccctccgtctccgccgcccccggccagaaggtcaccatctcctgctccggctcctcctccaacatcggcaacaactacgtctcctggtaccagcacctccccggcaccgcccccaagctcctcatctacgacacctactcccgcccctccggcatccccgaccgcttctccggctccaagtccggcacctccgccaccctcgccatcaccggcctccagaccggcgacgaggccgactactactgcggcacctgggacggctccggcggcgtcttcggcaccggcaccaaggtcaccgtcctc

SEQ ID NO: 17716 - RNA, 321 nt, synthetic construct
  misc_feature 1..321: note = derived and/or modified sequence opt2 from anti-HIV_119-057090_VR-Chain
  source 1..321: mol_type = other RNA
cagtccgtcctcacccagcccccctccgtctccgccgcccccggccagaccgtcaccatctcctgctccggctccacctccaacatcggcaagaacgacgtctcctggtaccagcagctccccggcaccgcccccaagctcctcatctccgagaacaaccgccgcccctccggcacccccgaccgcttctccgcctccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17717 - RNA, 333 nt, synthetic construct
  misc_feature 1..333: note = derived and/or modified sequence opt2 from anti-HIV_119-055754_VR-Chain
  source 1..333: mol_type = other RNA
cagtccgtcctcacccagcccccctccgtctccgccgcccccggccagaaggtcaccatctcctgctccggcaactcctcctccatcggcaacaacttcgtctcctggtaccagcagctccccggcaccgcccccaagctcctcgtctacgagaactaccgccgcccctccggcatccccgaccgcttctccggctccaagtccggcacctccgccaccctcgccatcgacggcctccagacctgggacgaggccgactaccactgcgccatctggggcgtccgcaagggcgtcggcgccgtcttcggcaccggcaccaaggtcaccgtcgtc

SEQ ID NO: 17718 - RNA, 324 nt, synthetic construct
  misc_feature 1..324: note = derived and/or modified sequence opt2 from anti-HIV_119-054899_VR-Chain
  source 1..324: mol_type = other RNA
cagtccgtcctcacccagcccccctccgtctccgccgcccccggccagaaggtcaccatctcctgctccggctccaactcctacatcggcaacaagtacgtctcctggtaccagcagttccccggcaccgcccccaagctcctcatccacgagaacaaccgccgcccctccggcacccccgaccgcttctccggctccaagtccggcacctccgccaccctcgccatctccggcctccagaccggcgacgaggccgactactactgcgagacctgggacggctccggcggcgtcttcggcaccggcaccaaggtcaccgtcctc

SEQ ID NO: 17719 - RNA, 324 nt, synthetic construct
  misc_feature 1..324: note = derived and/or modified sequence opt2 from anti-HIV_119-054501_VR-Chain
  source 1..324: mol_type = other RNA
cagtccgtcctcacccagcccccctccgtctccgccgcccccggccagaaggtcaccatctcctgctccggcacctcctccaacatcggcaacaactacgtctcctggtaccagcacctccccggcaccgcccccaagctcctcatcttcgagaccaacaagcgcccctccggcatccccgaccgcttctccgcctccaagtccggcacctccgccaccctcgccatcaccggcctccagaccggcgacgaggccgactactactgcgagacctgggacggctccggcggcgtcttcggccccggcacccgcgtcaccgtcctc

SEQ ID NO: 17720 - RNA, 324 nt, synthetic construct
  misc_feature 1..324: note = derived and/or modified sequence opt2 from anti-HIV_119-051867_VR-Chain
  source 1..324: mol_type = other RNA
cagtccgtcctcacccagcccccctccgtctccgccgcccccggccagaaggtcaccatctcctgctccggcaactcctccaacatcggcaacaacttcatctcctggtaccagcagctccccggcaccgcccccaagctcctcatctacgagaacgaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17721 - RNA, 324 nt, synthetic construct
  misc_feature 1..324: note = derived and/or modified sequence opt2 from anti-HIV_119-051814_VR-Chain
  source 1..324: mol_type = other RNA
cagtccgtcctcacccagcccccctccgtctccgccgcccccggccagaaggtcaccatctcctgctccggctccaactccaacatcggcaacaaggacgtctcctggtaccagcagatccccgccaccgcccccaagctcctcatctacgagaacaacaagcgcccctccggcatccccgaccgcttctccggctccaagtccggcacctccgccaccctcgccatcaccggcctccagaccggcgacgaggccgactactactgcgccacctgggacggccgcgtctccgtcatcggcaccggcaccaacgtcatcgtcctc

SEQ ID NO: 17722 - RNA, 321 nt, synthetic construct
  misc_feature 1..321: note = derived and/or modified sequence opt2 from anti-HIV_119-051567_VR-Chain
  source 1..321: mol_type = other RNA
cagtccgtcctcacccagcccccctccgtctccgccgcccccggccagaaggtcaccatctactgctccggctcccgctccaacatcggccgcaactacgcctcctggtaccagcagctccccggcaccgcccccaagctcctcatcttcgacaacaaccgccgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17723 - RNA, 324 nt, synthetic construct
  misc_feature 1..324: note = derived and/or modified sequence opt2 from anti-HIV_119-051483_VR-Chain
  source 1..324: mol_type = other RNA
cagtccgtcctcacccagcccccctccgtctccgccgcccccggccagaagctcaccatctcctgctccggcacctcctccaacatcggcaacaactacgtctcctggtaccagcacctccccggcaccgcccccaagctcctcatctacgagaacaaccgccgcccctccggcatccccgagcgcttctccgcctccaagtccggcacctccgccaccctcggcatcaccggcctccagaccggcgacgaggccgactactactgcgagacctgggacgactccggcggcgtcttcggcaccggcaccaaggtcaccgtcctc

SEQ ID NO: 17724 - RNA, 333 nt, synthetic construct
  misc_feature 1..333: note = derived and/or modified sequence opt2 from anti-HIV_119-050913_VR-Chain
  source 1..333: mol_type = other RNA
cagtccgtcctcacccagcccccctccgtctccgccgcccccggccagaaggtcaccatctcctgctccggcggcacctccaacatcggcaacaactacgtctcctggtaccagcagctccccggcaccgccccccgcctcctcatctacgagaccaacaagcgcccctccggcatccccgaccgcttcttcggctccaagtccggcacctccgccaccctcgccatctccggcctccagaccggcgacgaggccgactactactgcaccgtctggggcgtccgcaagggcgtcggcgccgtcttcggcaccggcaccaaggtcaccgtcctc

SEQ ID NO: 17725 - RNA, 333 nt, synthetic construct
  misc_feature 1..333: note = derived and/or modified sequence opt2 from anti-HIV_119-050187_VR-Chain
  source 1..333: mol_type = other RNA
cagtccgtcctcacccagcccccctccgtctccgccgcccccggccagaaggtcaccatctcctgctccggctcctcctccaacatcggcaagaactccgtctcctggtaccagcagttccccggcaccgcccccaagctcctcatctacgagaacaacaagcgcccctccggcatccccgaccgcttctccgactcccagtccggcacctccgccaccctcgccatcaccggcctccagaccggcgacgaggccgactactcctgcgccacctgggccgcctccctcaactccgcccgcgtcttcggcaccggcacccgcgtcaccgtcctc

SEQ ID NO: 17726 - RNA, 324 nt, synthetic construct
  misc_feature 1..324: note = derived and/or modified sequence opt2 from anti-HIV_119-049069_VR-Chain
  source 1..324: mol_type = other RNA
cagtccgtcctcacccagcccccctccgtctccgccgcccccggccagaaggtcaccatctcctgctccggctccacctccaacatcggcaagtccgacgtcttctggtaccagcagctccccggcaccgcccccaagctcctcatctccgagacctcccgccgcccctccggcacccccgaccgcttctccggctccaagtccggcacctccgccaccctcaccatcaccggcctccagaccggcgacgaggccgactactactgcgaggcctgggacggctccggcggcgtcttcggcaccggcaccaaggtcaccgtcctc

SEQ ID NO: 17727 - RNA, 333 nt, synthetic construct
  misc_feature 1..333: note = derived and/or modified sequence opt2 from anti-HIV_119-048517_VR-Chain
  source 1..333: mol_type = other RNA
cagtccgtcctcacccagcccccctccgtctccgccgcccccggccagaaggtcaccatctcctgctccggctccaagttcaacatcggcaacaaggacgtctcctggtaccagcactcccccggcaccgcccccaagctcctcatctacgagaacaacaagcgcccctccggcatccccgaccgcttctccggctccaagtccggcacctccgccaccctcggcatctccggcctccagaccggcgacgaggccgactactgctgcgccgtctggggcgtccgccgcggcgccggcgccgtcttcggcgccggcaccaaggtcaccgtcctc

SEQ ID NO: 17728 - RNA, 333 nt, synthetic construct
  misc_feature 1..333: note = derived and/or modified sequence opt2 from anti-HIV_119-048470_VR-Chain
  source 1..333: mol_type = other RNA
cagtccgtcctcacccagcccccctccgtctccgccgcccccggccagaaggtcaccatctcctgctccggctccacctccaacatcggcaagaacctcgtctcctggtaccagcagttccccggcaccgcccccaagctcctcatctacgagaacaaccgccgcccctccggcatccccgaccgcttctccggctccaagtccggcacctccgccaccctcgtcatcaccggcctccagaccggcgacgaggccgacttctactgcggcacctggggcggctccctccgcgccggcggcgtcatcggcaccggcacccgcgtcaccgtcctc

SEQ ID NO: 17729 - RNA, 282 nt, synthetic construct
  misc_feature 1..282: note = derived and/or modified sequence opt2 from anti-HIV_119-048303_VR-Chain
  source 1..282: mol_type = other RNA
tccgtcctcacccagcccccctccgtctccgccgcccccggccagaacatcaccatctcctgctccggctccatctccaacatcgcctccaacttcatctcctggtaccagcagctccccggcaccgcccccaagatcatcatctacgacaacgaccagcgccccctcggcatccccgcccgcttctccggctccaagtccggcgcctccgccaccctcgtcatcaccggcctccagaccggcgacgaggccgactactactgcggcacctgggacggctcc

SEQ ID NO: 17730 - RNA, 333 nt, synthetic construct
  misc_feature 1..333: note = derived and/or modified sequence opt2 from anti-HIV_119-048021_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgacaacaacaagcgcccctccggcatccccgaccgcttctccggctccaagtccggcacctccgccaccctcgtcatcaccggcctccagaccggcgacgaggccgacttctactgcggcacctgggacggctccctctccggcggcggcgtcatcggcaccggcacccgcgtcaccgtcctc

SEQ ID NO: 17731 - RNA, 324 nt, synthetic construct
  misc_feature 1..324: note = derived and/or modified sequence opt2 from anti-HIV_119-047928_VR-Chain
  source 1..324: mol_type = other RNA
cagtccgtcctcacccagcccccctccgtctccgccgcccccggccagaaggtcaccatctcctgctccggctccaactccaacatcggcaacaactgcgtctcctggtaccagcaggtccccggcaccgcccccaagctcctcatctacgagaacaaccgccgcccctccggcatccccgaccgcttctccggctccaagtccggcacctccgccaccctcgccatctccggcctccagaccggcgacgaggccgactactactgcggcacctgggacggctccggcggcgtcttcggcaccgccaccaaggtcaccgtcctc

SEQ ID NO: 17732 - RNA, 324 nt, synthetic construct
  misc_feature 1..324: note = derived and/or modified sequence opt2 from anti-HIV_119-047384_VR-Chain
  source 1..324: mol_type = other RNA
cagtccgtcctcacccagcccccctccgtctccgccgcccccggccagaaggtcaccatctcctgctccggctccaactccaacatcggcaacaaggacgtctcctggtaccgccaggtcccccccaccgcccccaagctcctcatctacgagaacaacaagcgcccctccggcatccccgaccgcttctccggctccaagtccggcacctccgccaccctcgccatcaccggcctccagaccggcgacgaggccgactactactgcgccacctgggacggccgcgtctccgtcttcggcaccggcaccaaggtcgccgtcctc

SEQ ID NO: 17733 - RNA, 333 nt, synthetic construct
  misc_feature 1..333: note = derived and/or modified sequence opt2 from anti-HIV_119-047145_VR-Chain
  source 1..333: mol_type = other RNA
cagtccgtcctcacccagcccccctccgtctccgccgcccccggccagaccgtcaacatctcctgctccggctccaactccaacatcggctccaagtacgtctcctggtaccagcacttccccggcaccgcccccaagctcctcatctacgagaacaacaagcgctcctccggcatccccgaccgcttctccggctccaagtccgccacctccgccaccctcgccatcaccggcctccagaccggcgacgaggccgactactactgcgccacctgggccccctccctcaactccgcccgcgtcttcggcaccggcaccaaggtcaccgtcctc

SEQ ID NO: 17734 - RNA, 333 nt, synthetic construct
  misc_feature 1..333: note = derived and/or modified sequence opt2 from anti-HIV_119-046752_VR-Chain
  source 1..333: mol_type = other RNA
cagtccgtcctcacccagcccccctccgtctccgccgcccccggccagaaggtcaccatctcctgctccggcaactcctcctccatcggcaacaacttcgtctcctggtaccagcagctccccggcaccgcccccaagctcctcgtctacgagaactaccgccgcccctccggcatctccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17735 - RNA, 324 nt, synthetic construct
  misc_feature 1..324: note = derived and/or modified sequence opt2 from anti-HIV_119-046660_VR-Chain
  source 1..324: mol_type = other RNA
cagtccgtcctcacccagcccccctccgtctccgccgcccccggccagaaggtcaccatctcctgctccggctcctcctccaacatcggcaaccactacgtctcctggtaccagcagctccccggcaccgcccccaagctcctcatctacgacaacaacaagcgcccctccggcatccccgaccgcttctccgcctccaagtccggcacctccgccaccctcggcatcaccggcctccagaccggcgacgaggccgactactactgcgccacctgggacggccgcgtctccgtcatcggcaccggcaccaaggtcaccgtcgtc

SEQ ID NO: 17736 - RNA, 333 nt, synthetic construct
  misc_feature 1..333: note = derived and/or modified sequence opt2 from anti-HIV_119-046202_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcgtctacgagaactaccgccgcccctccggcatccccgaccgcttctccggctccaagtccggcacctccgccaccctcgccatcaccggcctccagaccggcgacgaggccgactaccactgcgccatctggggcgtccgcaagggcgtcggcgccgtcttcggcaccggcaccaaggtcaccgtcgtc

SEQ ID NO: 17737 - RNA, 333 nt, synthetic construct
  misc_feature 1..333: note = derived and/or modified sequence opt2 from anti-HIV_119-045790_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagtacctccccggcaccgcccccaagctcctcttctacgaggacaaccgccgcccctccggcacccccgaccgcttctccggctccaagtccggcacctccgccaccctcgccatctccggcctccagaccggcgacgaggccgactactactgcaccatctggggcgtccgcaagggcgtcggcgccgtcttcggcaccggcaccaaggtcaccgtcctc

SEQ ID NO: 17738 - RNA, 333 nt, synthetic construct
  misc_feature 1..333: note = derived and/or modified sequence opt2 from anti-HIV_119-044670_VR-Chain
  source 1..333: mol_type = other RNA
cagtccgtcctcacccagcccccctccgtctccggcgcccccggcgagcgcgtcaccatctcctgcaccggcaacacctccaacatcggcacctacgacgtccagtggtaccagcacctccccggcaccgccccccgcctcctcatctaccacaacgtcaacctcccctccggcgtccccgaccgcttctccgcctccaagtccggcacctccgccaccctcgccatcaccggcctccagaccggcgacgaggccgactactactgcaccatctggggcgtccgcaagggcgtcggcgccgtcttcggcaccggcaccaaggtcaccgtcctc

SEQ ID NO: 17739 - RNA, 321 nt, synthetic construct
  misc_feature 1..321: note = derived and/or modified sequence opt2 from anti-HIV_119-044140_VR-Chain
  source 1..321: mol_type = other RNA
cagtccgtcctcacccagcccccctccgtctccgccgcccccggccagaaggtcaccatctcctgctccggcggcacctccaacatcggcaaccacttcgtctcctggtaccgccacctccccggcaccgcccccaagctcctcatctacgagaacaacaaccgcccctccggcatccccgaccgcttctccggcgccaagtccggcacctccgccaccctcgccatcaccggcctccagaccggcgacgagggcgactactactgcgccacctggtccggctccctcaacatcggcaccggcaccaaggtcaccgtcctc

SEQ ID NO: 17740 - RNA, 333 nt, synthetic construct
  misc_feature 1..333: note = derived and/or modified sequence opt2 from anti-HIV_119-042776_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcacctccccggcaccgcccccaagctcctcatctacgagtccgcccgccgcccctccggcacccccgaccgcttctccggctccaagtccggcacctccgccaccctcgccatcaccggcctccagaccggcgacgaggccgactactactgcaccctctggggcgtccgcaagggcgtcggcgccgtcttcggcaccggcacccgcgtcaccgtcctc

SEQ ID NO: 17741 - RNA, 333 nt, synthetic construct
  misc_feature 1..333: note = derived and/or modified sequence opt2 from anti-HIV_119-042581_VR-Chain
  source 1..333: mol_type = other RNA
cagtccgtcctcacccagcccccctccgtctccgccgcccccggccagaaggtcaccatctcctgctccggctcctcctccaacatcggcaacaacttcgtctcctggtaccagcagctccccggcaccgcccccaagctcctcatcttcgagacccaccgccgcccctccggcatccccgaccgcttctccggctccaagtccggcacctccgccaccctcgccatcaccggcctccagtccggcgacgaggccgactactactgcgccgtctggggcgtccgccagggcgccggcgccgtcttcggcaccggcaccaaggtcaccgtcctc

SEQ ID NO: 17742 - RNA, 333 nt, synthetic construct
  misc_feature 1..333: note = derived and/or modified sequence opt2 from anti-HIV_119-040905_VR-Chain
  source 1..333: mol_type = other RNA
cagtccgtcctcacccagcccccctccgtctccgccgcccccggccagaaggtcaccatctcctgctccggcaactcctccaacatcggcgacaacttcgtctcctggtaccagcagctccccggcatcgcccccaagctcctcgtctacgagaccaacaagcgcccctccggcatccccgaccgcttcgccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17743 - RNA, 321 nt, synthetic construct
  misc_feature 1..321: note = derived and/or modified sequence opt2 from anti-HIV_119-040322_VR-Chain
  source 1..321: mol_type = other RNA
cagtccgtcctcacccagcccccctccgtctccgccgcccccggccagaaggtcgtcatctcctgctccggctcctcctccatcatcgagaagaactccatctcctggtaccagcagggccccggcgccgcccccaagctcctcatctacgagaacgacaagcgcccctccggcatccccgaccgcttctccggctccaagtccggcaccaccggcaccctcgccatcaccggcctccagaccggcgacgaggccgactacttctgcgccacctggtccggccgcctcaacatcggcaccggcaccaaggtcaccgtcctc

SEQ ID NO: 17744 - RNA, 324 nt, synthetic construct
  misc_feature 1..324: note = derived and/or modified sequence opt2 from anti-HIV_119-039892_VR-Chain
  source 1..324: mol_type = other RNA
cagtccgtcctcacccagcccccctccgtctccgccgcccccggccagaaggtcaccatctcctgctccggctccaacgccaacatcggcaacaaggacgtctcctggtaccagcagctccccgccaccgcccccaagctcctcatctacgagtccaacaagcgcccctccggcatccccgaccgcttctccggctccaagtccggcacctccgccaccctcgccatcaccggcctccagaccggcgacgaggccgactactactgcgccacctgggacggccgcgtctccggcatcggcaccggcaccaaggtcaccgtcctc

SEQ ID NO: 17745 - RNA, 324 nt, synthetic construct
  misc_feature 1..324: note = derived and/or modified sequence opt2 from anti-HIV_119-039764_VR-Chain
  source 1..324: mol_type = other RNA
cagtccgtcctcacccagcccccctccgtctccgccgcccccggccagaaggtcaccatctcctgctccggctccgcctccaacatcggcaagaacttcgtctcctggtaccagcaggtccccggcaccgcccccaagctcctcatctacgagaacaaccgccgcccctccggcacccccgaccgcttctccggctccaagtccggcacctccggcaccctcgccatctccggcctccagaccggcgacgaggccgactactactgcgagacctgggacggctccggcggcgtcttcggcaccggcaccaaggtcaccgtcctc

SEQ ID NO: 17746 - RNA, 333 nt, synthetic construct
  misc_feature 1..333: note = derived and/or modified sequence opt2 from anti-HIV_119-039188_VR-Chain
  source 1..333: mol_type = other RNA
cagtccgtcctcacccagcccccctccctctccggcgcccccggccagaccgtcaccatctcctgctccggctcctcctccaacatcggcaacaactacgtctcctggtaccagcagctccccggcaccgcccccaagctcctcatctacgactccaaccgccgcccctccggcatccccgaccgcttctccggctccaagtccggcacctccgccaccctcgccatctccggcctccagaccggcgacgaggccgactactgctgcgccgtctggggcgtccgccgcggcgccggcgccgtcttcggcgccggcaccaaggtcaccgtcctc

SEQ ID NO: 17747 - RNA, 321 nt, synthetic construct
  misc_feature 1..321: note = derived and/or modified sequence opt2 from anti-HIV_119-039058_VR-Chain
  source 1..321: mol_type = other RNA
cagtccgtcctcacccagcccccctccgtctccggcgcccccggccagcgcgtcaccatctcctgcaccggctcctcctccaacatcggcaacaactacgtctcctggtaccgccgcctccccggcaccgcccccaagctcctcatctacgagaacaacaagcgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17748 - RNA, 321 nt, synthetic construct
  misc_feature 1..321: note = derived and/or modified sequence opt2 from anti-HIV_119-038837_VR-Chain
  source 1..321: mol_type = other RNA
cagtccgtcctcacccagcccccctccgtctccgccgcccccggccagaaggtcaccatctcctgctccggcggcacctccaacatcggcaacaacttcgtctcctggtaccagcacctccccggcaccgcccccaagctcctcatcttcgagaacaacaagcgcccctccggcgtccccgaccgcttctccggcgccaagtccggcacctccgccaccctcgccatcaccggcctccagaccggcgacgagggcgactactactgcgccacctggtccggctccctcaacatcggcaccggcaccaaggtcaccgtcctc

SEQ ID NO: 17749 - RNA, 321 nt, synthetic construct
  misc_feature 1..321: note = derived and/or modified sequence opt2 from anti-HIV_119-038396_VR-Chain
  source 1..321: mol_type = other RNA
cagtccgtcctcacccagcccccctccgtctccgccacccccggccagaaggtcaccatctcctgctccggctccaactccaacatcggcaacaagtacgtctcctggtaccagctcttccccggcaccgcccccaagctcctcatctccgagaacaaccgccgcccctccggcacccccgaccgcttctccggctccaagtccggcacctccgccaccctcgccatcaccggcctccagaccggcgacgaggccgactactactgcgccacctggtccggctccctcaacatcggcaccggcaccaaggtcaccgtcctc

SEQ ID NO: 17750 - RNA, 321 nt, synthetic construct
  misc_feature 1..321: note = derived and/or modified sequence opt2 from anti-HIV_119-036918_VR-Chain
  source 1..321: mol_type = other RNA
cagtccgtcctcacccagcccccctccgtctccgccgcccccggccagaaggtcaccatctcctgctccggcgccacctccaacatctgggaccactacgtctcctggtacctccaggtccccggcaccgccccccgcctcctcatctacgacaacgacaagcgcccctccggcatccccgaccgcttctccggctccaagtccggcacctccgccaccctcgccatcaccggcctccagaccggcgacgagggcgactactactgcgccacctggtccggctccctcaacatcggcaccggcaccaaggtcaccgtcctc

SEQ ID NO: 17751 - RNA, 324 nt, synthetic construct
  misc_feature 1..324: note = derived and/or modified sequence opt2 from anti-HIV_119-036592_VR-Chain
  source 1..324: mol_type = other RNA
cagtccgtcctcacccagcccccctccgtctccgccgcccccggccagaaggtcaccatctcctgctccggctccaactccaacaccggcaacaaggacgtctcctggtaccagcaggtccccgccaccgcccccaagctcctcatctacgagtccaacaagcgcccctccggcatccccgaccgcttctccggctccaagtccggcacctccgccaccctcgccatcaccggcctccagaccggcgacgaggccgactactactgcgccatctgggacggccgcgtctccgtcatcggcaccggcaccaaggtcaccgtcctc

SEQ ID NO: 17752 - RNA, 324 nt, synthetic construct
  misc_feature 1..324: note = derived and/or modified sequence opt2 from anti-HIV_119-036310_VR-Chain
  source 1..324: mol_type = other RNA
cagtccgtcctcacccagcccccctccgtctccgccgcccccggccagaaggtcaccatctcctgctccggctccacctccaacatcggccagaactacgtctcctggtaccagcagctccccggcaccgcccccaagctcctcatctacgagaacaaccgccgcccctccggctcccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17753 - RNA, 333 nt, synthetic construct
  misc_feature 1..333: note = derived and/or modified sequence opt2 from anti-HIV_119-035618_VR-Chain
  source 1..333: mol_type = other RNA
cagtccgtcctcacccagcccccctccgtctccgccgcccccggccagaaggtcaccatctcctgctccggctcctccttcaccatcggcaacaaccacgtctcctggtaccagcagctccccggcaccgcccccaagctcctcatcttcgagtcccacaagcgcccctccggcgtccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17754 - RNA, 321 nt, synthetic construct
  misc_feature 1..321: note = derived and/or modified sequence opt2 from anti-HIV_119-035569_VR-Chain
  source 1..321: mol_type = other RNA
cagtccgtcctcacccagcccccctccgtctccggcgcccccggccagaccgtcaccatctcctgcaccggctcctcctccaacatcggcggctacgacgtccactggtaccagcagctccccggcaccgcccccaagctcctcatctacgagaacaaccgccgcccctccggcacccccgaccgcttctccggcgccaagtccggcacctccgccaccctcgccatcaccggcctccagaccggcgacgagggcgactactactgcgccacctggtccggctccctcaacatcggcaccggcaccaaggtcaccgtcctc

SEQ ID NO: 17755 - RNA, 324 nt, synthetic construct
  misc_feature 1..324: note = derived and/or modified sequence opt2 from anti-HIV_119-035466_VR-Chain
  source 1..324: mol_type = other RNA
cagtccgtcctcacccagcccccctccgtctccgccgccgccggccagaacgtcaacatctcctgctccggcaagaagtccaacatcggcaacaactacgtctcctggtaccagcagttccccggcaccgcccccaagctcctcatctacggcaacaccaaccgcccctccggcatccccgaccgcttctccggctccaagtccggcacctccgccaccctcgccatcaccggcctccagaccggcgacgacgccgactactactgcgagacctgggacggctccggcggcgtcttcggcaccggcaccaaggtcaccgtcctc

SEQ ID NO: 17756 - RNA, 333 nt, synthetic construct
  misc_feature 1..333: note = derived and/or modified sequence opt2 from anti-HIV_119-035157_VR-Chain
  source 1..333: mol_type = other RNA
cagtccgtcctcacccagcccccctccgtctccgccgcccccggccagaaggtcaccatctcctgctccggctcctcctccaacatcggcaacaacttcgtctcctggtaccagcagcgccccggcaccgcccccaagctcctcatctacgagaccaacaagcgcccctccggcatccccgaccgcttctccggctccaagtccggcacctccgccaccctcgccatcaccggcctccagaccggcgacgaggccgactactactgcgccacctgggccccccgcctcaactccgcccgcgtcttcggcaacggcaccatggtcaccgtcctc

SEQ ID NO: 17757 - RNA, 333 nt, synthetic construct
  misc_feature 1..333: note = derived and/or modified sequence opt2 from anti-HIV_119-035121_VR-Chain
  source 1..333: mol_type = other RNA
cagtccgtcctcacccagcccccctccgtctccgccgcccccggccagaaggtcaccatctcctgctccggctccacctcctacatcggcaacaagtacgtctcctggtaccagcagttccccggcgccgcccccaagctcctcatctacgagaacaacaagcgcccctccggcatccccgaccgcttctccgcctccaagtccgccacctccgccaccctcgccatcaccggcctccagaccggcgacgaggccgactactgctgcgccgtctggggcgtccgccgcggcgccggcgccgtcttcggcgccggcaccaaggtcaccgtcctc

SEQ ID NO: 17758 - RNA, 324 nt, synthetic construct
  misc_feature 1..324: note = derived and/or modified sequence opt2 from anti-HIV_119-035046_VR-Chain
  source 1..324: mol_type = other RNA
cagtccgccctcacccagcccgcctccgtctccggctcccccggccagtccatcaccatctcctgcaccggcacctcctccgacgtcggctacgactacgtctcctggtaccgccaggtccccgccaccacccccaagctcctcatctacgagaacaacaagcgcccctccggcatccccgaccgcttctccggctccaagtccggcacctccgccaccctcgccatcaccggcctccagaccggcgacgaggccgactactactgcgccacctgggacggccgcgtctccgtcatcggcaccggcaccaaggtcaccgtcgtc

SEQ ID NO: 17759 - RNA, 324 nt, synthetic construct
  misc_feature 1..324: note = derived and/or modified sequence opt2 from anti-HIV_119-034754_VR-Chain
  source 1..324: mol_type = other RNA
cagtccgtcctcacccagcccccctccgtctccgccgcccccggcgagaaggtcaccatctcctgctccggctcctcctccaacatcggcaacaactacgtctcctggtaccagcagctccccggcaccgtccccaagctcctcatctacgacaacaacaagcgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17760 - RNA, 324 nt, synthetic construct
  misc_feature 1..324: note = derived and/or modified sequence opt2 from anti-HIV_119-034318_VR-Chain
  source 1..324: mol_type = other RNA
cagtccgtcctcacccagcccccctccgtctccgccgcccccggccagaagatcaccatctcctgctccggctcctcctccaacatcggcaacaacgacgtctcctggtaccagcagctccccggcaccgcccccaagctcctcatctacgagaacgaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17761 - RNA, 333 nt, synthetic construct
  misc_feature 1..333: note = derived and/or modified sequence opt2 from anti-HIV_119-033780_VR-Chain
  source 1..333: mol_type = other RNA
cagtccgtcctcacccagcccccctccgtctccgccgcccccggccagcgcgtcaccatctcctgctccggcacctcctccaacatcggcgagaactacgtctcctggtaccagcagatccccggcaccgcccccaagctcctcatctacgagaacaacaagcgcccctccggcatccccgaccgcttctccggctccaagtccggcacctccgccaccctcgtcatcaccggcctccagaccggcgacgaggccgacttctactgcggcacctggggcggctccctccgcaccggcggcgtcctcggcaccggcacccgcgtcaccgtcctc

SEQ ID NO: 17762 - RNA, 333 nt, synthetic construct
  misc_feature 1..333: note = derived and/or modified sequence opt2 from anti-HIV_119-033632_VR-Chain
  source 1..333: mol_type = other RNA
cagtccgtcctcacccagcccccctccgtctccgccgcccccggccagcgcgtcaccatctcctgctccggcggctcctccaacatcggctccaactacgtctcctggtaccagcagctccccggcaccgcccccaagctcctcatctaccagaacaacaagcgcccctccggcatccccgaccgcttctccggctccaagtccggcacctccgccaccctcggcatcaccggcctccagaccggcgacgaggccgactactactgcaccgtctggggcgtccgcaagggcgtcggcgccgtcttcggcaccggcaccaaggtcaccgtcctc

SEQ ID NO: 17763 - RNA, 333 nt, synthetic construct
  misc_feature 1..333: note = derived and/or modified sequence opt2 from anti-HIV_119-033183_VR-Chain
  source 1..333: mol_type = other RNA
cagtccgtcctcacccagcccccctccgtctccgccgcccccggccagatggtcaccatctcctgctccggcggcgcctccaacctcggcaagaactccgtctcctggtaccagcagctccccggcaccgcccccaagctcctcatctacgaggacaaccgccgcccctccggcacccccgaccgcttctccggctcccgctccggcacctccgccaccctcgccatcaccggcctccagaccggcgacgaggccgactactactgcaccatctggggcgtccgcaagggcgtcggcgccgtcttcggcaccggcaccaaggtcaccgtcctc

SEQ ID NO: 17764 - RNA, 333 nt, synthetic construct
  misc_feature 1..333: note = derived and/or modified sequence opt2 from anti-HIV_119-030696_VR-Chain
  source 1..333: mol_type = other RNA
cagtccgtcctcacccagcccccctccgtctccggcgcccccggccagatcgtcaccctctcctgcaccggcgccatgaccaacatcggcaacaacgacgtccactggtaccagcacctccccggcaccggccccaagctcctcatctacgagaacaacaagcgcccctccggcatccccgaccgcttctccggctccaagtccggcacctccgccaccctcgtcatcaccggcctccagaccggcgacgaggccgacttctactgcggcacctgggacggctccctccgcaccggcggcgtcatcggcaccggcacccgcgtcaccgtcctc

SEQ ID NO: 17765 - RNA, 324 nt, synthetic construct
  misc_feature 1..324: note = derived and/or modified sequence opt2 from anti-HIV_119-030059_VR-Chain
  source 1..324: mol_type = other RNA
cagtccgtcctcacccagcccccctccgtctccgccgcccccggccagaaggtcgtcatctcctgctccggctcctcctccatcatcgagaagaactccatctcctggtaccagcagggccccggcgccgcccccaagctcctcatctacgagaacgacaagcgcccctccggcatctccgaccgcttctccggctccaagtccgccacctccgccaccctcgccatcaccggcctccacaccggcgacgaggccgactactactgcgagacctgggacggctccggcggcgtcttcggcaccggcaccaaggtcaccgtcctc

SEQ ID NO: 17766 - RNA, 333 nt, synthetic construct
  misc_feature 1..333: note = derived and/or modified sequence opt2 from anti-HIV_119-029589_VR-Chain
  source 1..333: mol_type = other RNA
cagtccgtcctcacccagcccccctccgtctccgccgcccccggccagaaggtcaccatctcctgctccggcacctcctccaacatcggcaacaacttcgtctcctggtaccagctcctccccggcaccgccccccgcctcctcatctacgacaacaacaagcgcccctccggcacccccgaccgcttctccggctccaagtccggcacctccgccaccctcggcatcaccggcctccagaccggcgacgaggccgacttctactgcggcacctgggacggctccctccgcaccggcggcgtcatcggcaccggcacccgcgtcaccgtcctc

SEQ ID NO: 17767 - RNA, 324 nt, synthetic construct
  misc_feature 1..324: note = derived and/or modified sequence opt2 from anti-HIV_119-029448_VR-Chain
  source 1..324: mol_type = other RNA
cagtccgtcctcacccagcccccctccgtctccgccgcccccggccagaaggtcaccatctcctgctccggcaactcctccaacatcggcaagaactccgtctcctggtaccaccagctccccggcaccgcccccaagctcctcatctacgagaacgaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17768 - RNA, 333 nt, synthetic construct
  misc_feature 1..333: note = derived and/or modified sequence opt2 from anti-HIV_119-029220_VR-Chain
  source 1..333: mol_type = other RNA
cagtccgtcctcacccagcccccctccgtctccgccgcccccggccagaaggtcaccatctcctgctccggctccacctccaacatcggccagaactacgtctcctggtaccagcagctccccggcaccgcccccaagctcctcatctacgagaacgaccgccgcccctccggcatccccgaccgcttctccggctccaagtccggcacctccgccaccctcgccatctccggcctccagaccggcgacgaggccgactactgctgcgccgtctggggcgtccgccgcggcgccggcgccgtcttcggccccggcaccaaggtcaccgtcctc

SEQ ID NO: 17769 - RNA, 333 nt, synthetic construct
  misc_feature 1..333: note = derived and/or modified sequence opt2 from anti-HIV_119-028317_VR-Chain
  source 1..333: mol_type = other RNA
cagtccgtcctcacccagcccccctccgtctccgccgcccccggccagaaggtcaccatctcctgctccggctcctcctccaacatcggcaacgactacgtctcctggtaccagcagctccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcaccatctggggcgtccgcaagggcgtcggcgccgtcttcggcaccggcaccaaggtcaccgtcctc

SEQ ID NO: 17770 - RNA, 324 nt, synthetic construct
  misc_feature 1..324: note = derived and/or modified sequence opt2 from anti-HIV_119-028165_VR-Chain
  source 1..324: mol_type = other RNA
cagtccgtcctcacccagcccccctccgtctccgccgcccccggccagaccgtcaccatctcctgctccggcatcacctccaacatcggcaagaacgacgtctcctggtaccagcagctccccggcaccgcccccaagctcctcatctccgagaacaaccgccgcccctccggcatccccgaccgcttctccggctccaagtccggcacctccgccaccctcgccatcaccggcctccagaccggcgacgaggccgactactactgcgccatctgggacggccgcgtctccgtcatcggcaccggcaccaaggtcaccgtcctc

SEQ ID NO: 17771 - RNA, 324 nt, synthetic construct
  misc_feature 1..324: note = derived and/or modified sequence opt2 from anti-HIV_119-027147_VR-Chain
  source 1..324: mol_type = other RNA
cagtccgtcctcacccagcccccctccgtctccgccgcccccggccagaccgtcaccatctcctgctccggctccacctccgacatcggcaagaacgacgtctcctggtaccagcagctccccggcatcgcccccaagctcctcatctccgagaacaaccgccgcccctccggcacccccgaccgcttctccggctccaagtccggcacctccgccaccctcgccatcaccggcctccagaccggcgacgaggccgactactactgcgagacctgggacggctccggcgccgtcttcggcaccggcaccaaggtcaccgtcctc

SEQ ID NO: 17772 - RNA, 333 nt, synthetic construct
  misc_feature 1..333: note = derived and/or modified sequence opt2 from anti-HIV_119-026743_VR-Chain
  source 1..333: mol_type = other RNA
cagtccgtcctcacccagcccccctccgtctccgccgcccccggccagaacgtcaccatctcctgctccggctcctcctccaacatcggcaacaacttcgtctcctggtaccagcagcgccccggcaccggccccaagctcctcatctacgagaccaaccgccgcccctccggcatccccgaccgcttctccggctccaagtccggcacctccgccaccctcgccatcaccggcctccagaccggcgacgaggccgactactactgcgccacctgggccccctccctcaactccgcccgcgtcttcggcaccggcaccaaggtcaccgtcctc

SEQ ID NO: 17773 - RNA, 333 nt, synthetic construct
  misc_feature 1..333: note = derived and/or modified sequence opt2 from anti-HIV_119-026508_VR-Chain
  source 1..333: mol_type = other RNA
cagtccgtcctcacccagcccccctccgtctccgccgcccccggccagaaggtcaccatctcctgctccggctcctcctccaccatcggcaacaactacatctcctggtaccaggtcctccccggcaccgcccccaagctcgtcatcttcaagaacaacgagcgcccctcccgcgtccccgaccgcttctccggctccaagtccggcacctccgccaccctcggcatcaccggcctccagctcggcgacgagggcgactactactgcggcacctgggagacctccctctccggcggcggcgtcttcggcaccggcaccaaggtcaccgtcctc

SEQ ID NO: 17774 - RNA, 324 nt, synthetic construct
  misc_feature 1..324: note = derived and/or modified sequence opt2 from anti-HIV_119-025683_VR-Chain
  source 1..324: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccgactcccagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17775 - RNA, 333 nt, synthetic construct
  misc_feature 1..333: note = derived and/or modified sequence opt2 from anti-HIV_119-025614_VR-Chain
  source 1..333: mol_type = other RNA
cagtccctcctcacccagcccccctccgtctccgccgcccccggccagaacgtcatcatctcctgctccggctcctcctccaacatcggcaagaactacgtcgcctggtaccagcaggtccccggcaccgcccccaagatcgtcgtcttcgagaccaccaaccgcccctccggcatccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17776 - RNA, 324 nt, synthetic construct
  misc_feature 1..324: note = derived and/or modified sequence opt2 from anti-HIV_119-025548_VR-Chain
  source 1..324: mol_type = other RNA
cagtccatcctcacccagcccccctccgtctccgccgcccccggccagaaggtcaccatctcctgctccggctcctcctccaacatcggcaacaactacgtctcctggtaccagcacgtccccggcaccgcccccaagctcctcatctacgagaacaaccgccgcccctccggcacccccgaccgcttctccggctccaagtccggcacctccgccaccctcgccatcaccggcctccagtccggcgacgaggccgactactactgcggcacctgggacggctccggcggcgtcttcggcaccggcaccaaggtcaccgtcctc

SEQ ID NO: 17777 - RNA, 333 nt, synthetic construct
  misc_feature 1..333: note = derived and/or modified sequence opt2 from anti-HIV_119-025526_VR-Chain
  source 1..333: mol_type = other RNA
cagtccgtcctcacccagcccccctccgtctccgccgcccccggccagaaggtcaccatctcctgctccggctccgcctccaacatcggcaagaacttcgtctcctggtaccagcagctccccggcaccgcccccaagctcctcatctacgagaacaaccgccgcccctccggcacccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17778 - RNA, 324 nt, synthetic construct
  misc_feature 1..324: note = derived and/or modified sequence opt2 from anti-HIV_119-023552_VR-Chain
  source 1..324: mol_type = other RNA
cagtccgtcctcacccagcccccctccgtctccgccgcccccggccagaccgtcaccatctcctgctccggctccacctccaacatcggcaagaacgacgtctcctggtaccagcagctccccggcaccgcccccaagctcctcatctccgagaacaaccgccgcccctccggcacccccgaccgcttctccgcctccaagtccggcacctccgccaccctcgccatcaccggcctccagaccggcgacgaggccgactactactgcgagacctggcacggctccggcggcgtcttcggcaccggcaccaaggtcaccgtcctc

SEQ ID NO: 17779 - RNA, 321 nt, synthetic construct
  misc_feature 1..321: note = derived and/or modified sequence opt2 from anti-HIV_119-023092_VR-Chain
  source 1..321: mol_type = other RNA
cagtccgtcctcacccagcccccctccgtctccgccgcccccggccagaaggtcaccatctcctgctccggctccacctccgacctcggccagacccgcgtctcctggtaccagcagctcccccgctccgcccccgagctcctcatcttcgagaacaaccgccgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17780 - RNA, 324 nt, synthetic construct
  misc_feature 1..324: note = derived and/or modified sequence opt2 from anti-HIV_119-022793_VR-Chain
  source 1..324: mol_type = other RNA
cagtccgtcctcacccagcccccctccgtctccgccgcccccggccagaaggtcaccatctcctgctccggcggcacctccaacatcggcaacaactacgtctcctggtaccgccgcctccccggcaccgcccccaagctcctcatctacgagaacaacaagcgcccctccggcatccccgaccgcttctccggcgccaagtccggcacctccgccaccctcggcatcaccggcctccagaccggcgacgaggccgactactactgcgagacctgggacgactccggcggcgtcttcggcaccggcaccaaggtcaccgtcctc

SEQ ID NO: 17781 - RNA, 324 nt, synthetic construct
  misc_feature 1..324: note = derived and/or modified sequence opt2 from anti-HIV_119-022395_VR-Chain
  source 1..324: mol_type = other RNA
cagtccgtcctcacccagcccccctccgtctccgccgcccccggccagaccgtcaccatctcctgctccggctccacctccaacatcggcaagaacgacgtctcctggtaccagcagctccccggcaccgcccccaagctcctcatctccgacaacaaccgccgcccctcctggacccccgaccgcttctccggctccaagtccggcacctccgccaccctcgccatcaccggcctccagaccggcgacgaggccgactactactgcgagacctgggacggctccggcggcgtcttcggccccggcacccgcgtcaccgtcctc

SEQ ID NO: 17782 - RNA, 333 nt, synthetic construct
  misc_feature 1..333: note = derived and/or modified sequence opt2 from anti-HIV_119-022334_VR-Chain
  source 1..333: mol_type = other RNA
cagtccgtcctcacccagcccccctccgtctccgccgcccccggccagaacgtcaacatctcctgctccggcggctcctccaacatcggctccaactacgtctcctggtaccagcagttccccggcaccgcccccaagcacctcatctacgagaacaacaagcgcccctccggcatccccgaccgcttctccgactcccagtccggcacctccgccaccctcggcatcaccggcctccagaccggcgacgaggccgactactactgcggcacctgggacggctccctccgcaccggcggcgtcatcggcaccggcacccgcgtcaccgtcctc

SEQ ID NO: 17783 - RNA, 321 nt, synthetic construct
  misc_feature 1..321: note = derived and/or modified sequence opt2 from anti-HIV_119-021866_VR-Chain
  source 1..321: mol_type = other RNA
cagtccgtcctcacccagcccccctccgtctccgccgcccccggccagcgcgtcaccatctcctgctccggctccgcctccaacatcggcaagaacttcgtctcctggtaccagcagctccccggcaaggcccccaagctcatcatctacgaggtcaccaagcgcccctccggcgtccccgcccgcttctccggctccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17784 - RNA, 324 nt, synthetic construct
  misc_feature 1..324: note = derived and/or modified sequence opt2 from anti-HIV_119-021278_VR-Chain
  source 1..324: mol_type = other RNA
cagtccgtcctcacccagcccccctccgtctccgccgcccccggccagaaggtcaccatctcctgctccggctccgcctccaacatcggcaagaacttcgtctcctggtaccagcagctccccggcaccgcccccaagctcctcatctacgagaacaaccgccgcccctccggcacccccgaccgcttctccggctcccgctccggcacctccgccaccctcggcatcaccggcctccagaccggcgacgaggcccactactactgcgagacctgggacgactccggcggcgtcttcggcaccggcaccaaggtcaccgtcctc

SEQ ID NO: 17785 - RNA, 333 nt, synthetic construct
  misc_feature 1..333: note = derived and/or modified sequence opt2 from anti-HIV_119-021183_VR-Chain
  source 1..333: mol_type = other RNA
cagtccgtcctcacccagcccccctccgtctccgccgcccccggccagaaggtcaccatctcctgctccggcaactcctccaacatcggcaacaacttcgtctcctggtaccagcagttccccggcaccgcccccaagctcctcgtcttcgagacccaccgccgcccctccggcatccccgaccgcttctccggctccaagtccggcacctccgccaccctcgccatcaccggcctccagaccggcgacgaggccgactactactgcgccgtctggggcgtccgccgcggcgtcggcgccgtcttcggcgccggcaccaaggtcaccgtcctc

SEQ ID NO: 17786 - RNA, 333 nt, synthetic construct
  misc_feature 1..333: note = derived and/or modified sequence opt2 from anti-HIV_119-019376_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcaggtccccggcaccgcccccaagctcctcgtctacgagacctaccgccgcccctccggcatccccgaccgcttctccggctccaagtccggcacctccgccaccctcgccatcaccggcctccagaccggcgacgaggccgactactactgcaccatctggggcgtccgcaagggcgtcggcgccgtcttcggcaccggcaccaaggtcaccgtcctc

SEQ ID NO: 17787 - RNA, 321 nt, synthetic construct
  misc_feature 1..321: note = derived and/or modified sequence opt2 from anti-HIV_119-019238_VR-Chain
  source 1..321: mol_type = other RNA
cagtccgtcctcacccagcccccctccgtctccgccgcccccggccagaaggtcaccatctcctgctccggcacctcctccaacatcggcaacaaccacgtctcctggtaccagcaggtccccggcaccgcccccaagctcctcatctacgagaacaacaagcgcccctccggcatccccgcccgcttctccgccgccaagtccggcacctccgccaccctcgccatcaccggcctccagaccggcgacgaggccgactacttctgcgccacctggtccggccgcctcaacatcggcaccggcaccaaggtcaccgtcctc

SEQ ID NO: 17788 - RNA, 333 nt, synthetic construct
  misc_feature 1..333: note = derived and/or modified sequence opt2 from anti-HIV_119-018500_VR-Chain
  source 1..333: mol_type = other RNA
cagtccgtcctcacccagcccccctccgtctccgccgcccccggccagaaggtcaacatctcctgctccggctcctcctccaacatcggcaacaacttcgtctcctggtaccagcagcgccccggcaccgcccccaagctcctcatctacgagaccaaccgccgcccctccggcatccccgaccgcttctccggctccaagtccggcacctccgccaccctcgccatcaccggcctccagaccggcgacgaggccgactactactgcgccacctgggccgcctccctcacctccgcccgcgtcttcggcatcggcaccaaggtcaccgtcctc

SEQ ID NO: 17789 - RNA, 324 nt, synthetic construct
  misc_feature 1..324: note = derived and/or modified sequence opt2 from anti-HIV_119-018318_VR-Chain
  source 1..324: mol_type = other RNA
cagtccgtcctcacccagcccccctccgtctccgccgcccccggccagaccgtcatcatctcctgctccggctccacctccaacatcggcaagaacgacgtctcctggtaccagcagctccccggcaccgcccccaagctcctcatctccgagaacaaccgccgcccctccggcacccccgaccgcttctccggctccaagtccggcacctccgccaccctcgccatcaccggcctccagaccggcgacgacgccgactactactgcgagacctgggacggctccggcggcgtcttcggcaccggcaccaaggtcaccctcgtc

SEQ ID NO: 17790 - RNA, 333 nt, synthetic construct
  misc_feature 1..333: note = derived and/or modified sequence opt2 from anti-HIV_119-018218_VR-Chain
  source 1..333: mol_type = other RNA
cagtccgtcctcacccagcccccctccgtctccgccgcccccggccagaaggtcaccatctcctgctccggcaactcctccaacatcggcaacaacttcgtctcctggtaccagcagctccccggcaccgcccccaagctcctcatctacgagaacaaccgccgcccctccggcatccccgaccgcttctccggctccaagtccggcacctccgccaccctcgccatctccggcctccagaccggcgacgaggccgactactggtgcgccgtctggggcgtccgccgcggcgccggcgccgtcttcggcgccggcaccaaggtcaccgtcctc

SEQ ID NO: 17791 - RNA, 324 nt, synthetic construct
  misc_feature 1..324: note = derived and/or modified sequence opt2 from anti-HIV_119-017876_VR-Chain
  source 1..324: mol_type = other RNA
cagtccgtcctcacccagcccccctccgtctccgccgcccccggccagaaggtcaccatctcctgctccggctccacctccaagatcggccagaactccgtctcctggtaccagcagctccccggcaccgcccccaagctcctcatctacgagaacgaccgccgcccctccggcacccccgaccgcttctccgcctccaagtccggcacctccgccaccctcgccatcaccggcctccagaccggcgacgaggccgactactactgcgagacctgggacgactccggcggcgtcttcggcaccggcaccaaggtcaccgtcctc

SEQ ID NO: 17792 - RNA, 324 nt, synthetic construct
  misc_feature 1..324: note = derived and/or modified sequence opt2 from anti-HIV_119-017740_VR-Chain
  source 1..324: mol_type = other RNA
cagtccgtcctcacccagcccccctccgtctccgccgcccccggccagaaggtcaccatctcctgctccggctccaactccaacatcggcaacaaggacgtctcctggtaccgccaggtccccgccaccgcccccaagctccccatctacgagaacaagaacgagccctccggcgtccccgaccgcttctccggctccaagtccggcacctccgccaccctcgccatcaccggcctccagaccggcgacgaggccgactactactgcgccacctgggacggccgcgtctccgtcatcggcaccggcaccaaggtcaccgtcgtc

SEQ ID NO: 17793 - RNA, 321 nt, synthetic construct
  misc_feature 1..321: note = derived and/or modified sequence opt2 from anti-HIV_119-017128_VR-Chain
  source 1..321: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggcgccaagtccggcacctccgccaccctcgccatcaccggcctccagaccggcgacgaggccgactacttctgctccacctggtccggctccctcaacttcggcaccggcacccgcgtcaccgtcctc

SEQ ID NO: 17794 - RNA, 324 nt, synthetic construct
  misc_feature 1..324: note = derived and/or modified sequence opt2 from anti-HIV_119-017044_VR-Chain
  source 1..324: mol_type = other RNA
cagtccgtcctcacccagcccccctccgtctccgccgcccccggccagaaggtcaccatctcctgctccggctccaactccaacatcggcaacaactacgtctcctggtaccaccacctccccggcaccgccccccgcctcctcatctacgacaacaacaagcgcccctccggcatccccgaccgcttctccggctccaagtccggcacctccgccaccctcgccatcaccggcctccagaccggcgacgaggccgactactactgcgccacctgggacggccgcgtctccgtcatcggcaccggcacccaggtcaccgtcctc

SEQ ID NO: 17795 - RNA, 321 nt, synthetic construct
  misc_feature 1..321: note = derived and/or modified sequence opt2 from anti-HIV_119-016644_VR-Chain
  source 1..321: mol_type = other RNA
cagtccgtcctcacccagcccccctccgtctccgccgcccccggccagaaggtcaccatctcctgctccggcggcacctccaacatcggcaacaactacgtctcctggtaccagcagctccccggcaccgcccccaagctcctcatctacgagaacaacaagcgcccctccggcatccccgcccgcttctccgccgccaagtccggcacctccgccaccctcgccatcaccggcctccagaccgaggacgaggccgactactactgcgccacctggtccggctccctcaacatcggcaccggcaccaaggtcaccgtcctc

SEQ ID NO: 17796 - RNA, 333 nt, synthetic construct
  misc_feature 1..333: note = derived and/or modified sequence opt2 from anti-HIV_119-015878_VR-Chain
  source 1..333: mol_type = other RNA
cagtccgccctcacccagcccccctccgcctccggctcccccggccagtccgtcaccatctcctgctccggctcctcctccaacatcggcaacaacttcgtctcctggtaccagcagcgccccggcaccgcccccaagctcctcatctacgagaccaacaagcgcccctccggcatccccgaccgcttctccggctccaagtccggcacctccgccaccctcgccatcaccggcctccagaccggcgacgaggccgactactactgcgccacctgggccccccgcctcaactccgcccgcgtcttcggcaacggcaccatggtcaccgtcctc

SEQ ID NO: 17797 - RNA, 321 nt, synthetic construct
  misc_feature 1..321: note = derived and/or modified sequence opt2 from anti-HIV_119-015538_VR-Chain
  source 1..321: mol_type = other RNA
cagtccgtcctcacccagcccccctccgtctccgccacccccggccagaaggtcaccatctcctgctccggctcctcctccaacatcggcaacaactacgtctcctggtaccgccgcctccccggcaccgcccccaagcacctcatctacgagaccaacaaccgcccctccggcgtccccgcccgcctctccgccgccaagtccggcacctccgccaccctcgccatcaccggcctccagaccgaggacgaggccgactactactgcgccacctggtccggctccctcaacatcggcaccggcaccaaggtcaccgtcctc

SEQ ID NO: 17798 - RNA, 321 nt, synthetic construct
  misc_feature 1..321: note = derived and/or modified sequence opt2 from anti-HIV_119-015455_VR-Chain
  source 1..321: mol_type = other RNA
cagtccgtcctcacccagcccccctccgtctccgccacccccggccagaaggtcaccatctcctgctccggctccaactccaacatcggcaacaaggacgtctcctggtaccagcacttccccggcaccgcccccaagctcctcatctacgagaacaacaagcgcccctccggcatccccgaccgcttctccggctccaagtccgccacctccgccaccctcaccatcaccggcctccagaccgaggacgaggccgactactactgcgccacctggtccggctccctcaacatcggcaccggcaccaaggtcaccgtcctc

SEQ ID NO: 17799 - RNA, 321 nt, synthetic construct
  misc_feature 1..321: note = derived and/or modified sequence opt2 from anti-HIV_119-014425_VR-Chain
  source 1..321: mol_type = other RNA
cagtccgtcctcacccagcccccctccgtctccgccgcccccggccagaaggtcaccatctcctgctccggcggcacctccaacatcggcaacaactacgtctcctggtaccagcacctccccggcaccgcccccaagctcctcatctacgagaacaacaagcgcccctccggcatccccgaccgcttctccggcgccaagtccggcacctccgccaccctcgccatcaccggcctccagaccggcgacgagggcgactactactgcgccacctggtccggctccctcaacatcggcaccggcaccaaggtcaccgtcctc

SEQ ID NO: 17800 - RNA, 324 nt, synthetic construct
  misc_feature 1..324: note = derived and/or modified sequence opt2 from anti-HIV_119-013582_VR-Chain
  source 1..324: mol_type = other RNA
cagtccatggtcacccagtccccctccgtctccgccgcccccggccagaaggtcaccatctcctgctccggcacctcctccaacatcggccagaactacgtctcctggtaccagcagctccccggcaccgcccccaagctcctcatctccgagaacaaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17801 - RNA, 333 nt, synthetic construct
  misc_feature 1..333: note = derived and/or modified sequence opt2 from anti-HIV_119-013364_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgacaacaacaagcgcccctccggcatccccgaccgcttctccggctccaagtccggcacctccgccaccctcgccatcaccggcctccacaccggcgacgaggccgactactactgcaccgtctggggcgtccgcaagggcgtcggcgccgtcttcggcaccggcaccaaggtcaccgtcctc

SEQ ID NO: 17802 - RNA, 333 nt, synthetic construct
  misc_feature 1..333: note = derived and/or modified sequence opt2 from anti-HIV_119-012886_VR-Chain
  source 1..333: mol_type = other RNA
cagtccatcctcacccagcccccctccgtctccgccgcccccggccagaaggtcaccatctcctgctccggctcctcctccaccatcggcaccaactacgtctcctggtaccagcagttccccggcaccgcccccaagctcctcgtcttcgagacccaccgccgcccctccggcatccccgaccgcttctccggctccaagtccggcacctccgccaccctcgccatcaccggcctccagaccggcgacgaggccgactactactgcgccgtctggggcgtccgccgcggcgtcggcgccgtcttcggcgccggcaccaaggtcaccgtcctc

SEQ ID NO: 17803 - RNA, 333 nt, synthetic construct
  misc_feature 1..333: note = derived and/or modified sequence opt2 from anti-HIV_119-012249_VR-Chain
  source 1..333: mol_type = other RNA
cagtccgtcctcacccagcccccctccgtctccggcgcccccggccagaaggtcaccatctcctgctccggctcctcctccaacatcggccgcaactacgtctcctggtaccagcagctccccggcaccgcccccaagctcctcatctacgagaacaacaagcgcccctccggcatccccgaccgcttctccggctccaagtccggcacctccgccaccctcgtcatcaccggcctccagaccggcgacgaggccgacttctactgcggcacctgggacggctccctctccggcggcggcgtcatcggcaccggcacccgcgtcaccgtcctc

SEQ ID NO: 17804 - RNA, 324 nt, synthetic construct
  misc_feature 1..324: note = derived and/or modified sequence opt2 from anti-HIV_119-012161_VR-Chain
  source 1..324: mol_type = other RNA
cagtccttcctcacccagcccccctccgtctccgccgcccccggccagaaggtcaccatctcctgctccggctccaactccaacatcggcaagaactacgtctcctggtaccagtacctccccggcaccgtccccaagctcctcatctacgagaacgacaagcgcccctccggcatccccggccgcttctccgcctccaagtccggcacctccgccaccctcgccatcaccggcctccagaccggcgacgaggccgactactactgcggcacctgggacggctccggcggcgtcttcggcaccggcaccaaggtcaccgtcctc

SEQ ID NO: 17805 - RNA, 324 nt, synthetic construct
  misc_feature 1..324: note = derived and/or modified sequence opt2 from anti-HIV_119-012110_VR-Chain
  source 1..324: mol_type = other RNA
cagtccgtcctcacccagcccccctccgtctccgccgcccccggccagaccgtcaccatctcctgctccggctccacctccaacatcggcaagaacgacgtctcctggtaccagcagctccccggcaccgcccccaagctcctcatctccgagaacaaccgccgcccctccggcacccccgaccgcttctccggctccaagtccggcacctccgccaccctcgccatctccggcctccagaccggcgacgaggccgactactactgcggcacctgggacggctccggcggcgtcttcggcaccggcaccaaggtcaccgtcctc

SEQ ID NO: 17806 - RNA, 333 nt, synthetic construct
  misc_feature 1..333: note = derived and/or modified sequence opt2 from anti-HIV_119-012100_VR-Chain
  source 1..333: mol_type = other RNA
caggccgtcctcacccagcccccctccgtctccgccgcccccggccagaaggtcgccatctcctgctccggctcctcctccaacatcggcaacaactacgtctcctggtaccagcagctccccggcaccgtccccaagctcctcatctacgacaccgacaagcgcccctccggcatccccgaccgcttctccggctccaagtccggcacctccgccaccctcggcatcacccgcctccagaccggcgacgaggccgactactactgcgccacctgggccccccgcctcaactccgcccgcgtcttcggcaacggcaccatggtcaccgtcctc

SEQ ID NO: 17807 - RNA, 324 nt, synthetic construct
  misc_feature 1..324: note = derived and/or modified sequence opt2 from anti-HIV_119-011651_VR-Chain
  source 1..324: mol_type = other RNA
cagtccgtcctcacccagcccccctccgtctccgccgcccccggccagaaggtcaccatctcctgctccggcaactcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcgccacctgggacggccgcgtctccgtcttcggcaccggcaccaaggtcgccgtcctc

SEQ ID NO: 17808 - RNA, 333 nt, synthetic construct
  misc_feature 1..333: note = derived and/or modified sequence opt2 from anti-HIV_119-011479_VR-Chain
  source 1..333: mol_type = other RNA
cagtccgtcctcacccagcccccctccgtctccgccacccccggccagaaggtcaccatctcctgctccggctccaactccaacatcggcaacaagtacgtctcctggtaccagcacttccccggcaccgcccccaagctcctcatctacgagaacaaccgccgcccctccggcatccccgaccgcttctccggctccaagtccggcacctccgccaccctcgccatcaccggcctccagaccggcgacgaggccgactactactgcaccatctggggcgtccgcaagggcgtcggcgccgtcttcggcaccggcaccaaggtcaccgtcctc

SEQ ID NO: 17809 - RNA, 333 nt, synthetic construct
  misc_feature 1..333: note = derived and/or modified sequence opt2 from anti-HIV_119-011232_VR-Chain
  source 1..333: mol_type = other RNA
cagtccgtcctcacccagcccccctccgtctccgccgcccccggccagaacgtcaacatctcctgctccggcggctcctccaacatcggctccaactacgtctcctggtaccagcagttccccggcaccgcccccaagctcctcatctacgacgacgacaagcgcccctccggcatcccccaccgcttctccgcctccaagtccggcacctccgccaccctcgccatctccggcctccagaccggcgacgaggccgactactgctgcgccgtctggggcgtccgccgcggcgccggcgccgtcttcggcgccggcaccaaggtcaccgtcctc

SEQ ID NO: 17810 - RNA, 333 nt, synthetic construct
  misc_feature 1..333: note = derived and/or modified sequence opt2 from anti-HIV_119-011175_VR-Chain
  source 1..333: mol_type = other RNA
cagtccgtcctcacccagcccccctccgtctccgccgcccccggccagaaggtcaccatctcctgctccggctccaactcctacatcggcaacaagtacgtctcctggtaccagcagttccccggcaccgcccccaagctcctcatctacgagaacaaccgccgcccctccggcatccccgaccgcttctccggctccaagtccggcacctccgccaccctcgccatctccggcctccagaccggcgacgaggccgactactgctgcgccgtctggggcgtccgccgcggcgccggcgccgtcttcggccccggcaccaaggtcaccgtcctc

SEQ ID NO: 17811 - RNA, 321 nt, synthetic construct
  misc_feature 1..321: note = derived and/or modified sequence opt2 from anti-HIV_119-008396_VR-Chain
  source 1..321: mol_type = other RNA
cagtccgtcctcacccagcccccctccgtctccgccgcccccggccagaaggtcaccatctcctgctccggctcctcctccaacatcggcaacaactacgtctcctggtaccagcaggtccccggcaccgcccccaagctcctcgtctacgagaacacccgccgcccctccggcgtccccgaccgcttctccggcgccaagtccggcacctccgccaccctcgccatcaccggcctccagaccggcgacgagggcgactactactgcgccacctggtccggctccctcaacatcggcaccggcaccaaggtcaccgtcctc

SEQ ID NO: 17812 - RNA, 324 nt, synthetic construct
  misc_feature 1..324: note = derived and/or modified sequence opt2 from anti-HIV_119-007148_VR-Chain
  source 1..324: mol_type = other RNA
cagtccgtcctcacccagcccccctccgtctccgccgcccccggccagaaggtcaccatctcctgctccggctccacctccaacatcggcaagaactacgtctcctggtaccagcacctccccggcaccgcccccaagctcctcctctacgagaacgaccgccgcccctccggcacccccgaccgcttctccggctccaagtccggcacctccgccaccctcgccatcaccggcctccacaccggcgacgaggccgactactactgcgagacctgggacggctccggcggcgtcttcggcaccggcaccaaggtcaccgtcctc

SEQ ID NO: 17813 - RNA, 333 nt, synthetic construct
  misc_feature 1..333: note = derived and/or modified sequence opt2 from anti-HIV_119-007029_VR-Chain
  source 1..333: mol_type = other RNA
cagtccgtcctcacccagcccccctccgtctccgccgcccccggccagaaggtcaccatctcctgctccggcaactcctccaacatcggcaacaacttcgtctcctggtaccagcaggtccccggcaccgcccccaagctcctcctctacgagacctaccgccgcccctccggcatctccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17814 - RNA, 324 nt, synthetic construct
  misc_feature 1..324: note = derived and/or modified sequence opt2 from anti-HIV_119-004707_VR-Chain
  source 1..324: mol_type = other RNA
cagtccgtcctcacccagcccccctccgtctccgccgcccccggccagaaggtcaccatctcctgctccggctccacctccaacatcggcaagaacgacgtctcctggtaccagcagctccccggcaccgcccccaagctcctcatctccgagaacaaccgccgcccctccggcacccccgaccgcttctccggctccaagtccggcacctccgccaccctcgccatcaccggcctccagaccggcgacgaggccgactactactgcgagacctgggacggctccggcggcgtcttcggcaccggcaccaaggtcaccgtcctc

SEQ ID NO: 17815 - RNA, 333 nt, synthetic construct
  misc_feature 1..333: note = derived and/or modified sequence opt2 from anti-HIV_119-003910_VR-Chain
  source 1..333: mol_type = other RNA
cagtccgtcctcacccagcccccctccgtctccgccgcccccggccagaaggtcgccatctcctgctccggcaacacctcctccatcggcaacaacttcgtctcctggtaccagcaggtccccggcaccgcccccaagctcctcgtctacgagacctaccgccgcccctccggcatccccgaccgcttctccggctccaagtccggcacctccgccaccctcgccatcaccggcctccagaccggcgacgaggccgactactactgcaccgtctggggcgtccgcaagggcgtcggcgccgtcttcggcaccggcaccaaggtcaccgtcctc

SEQ ID NO: 17816 - RNA, 321 nt, synthetic construct
  misc_feature 1..321: note = derived and/or modified sequence opt2 from anti-HIV_119-002450_VR-Chain
  source 1..321: mol_type = other RNA
cagtccgtcctcacccagcccccctccgtctccggcgcccccggccagcgcgtcaccatctcctgcaccggctcctcctccaacatcggcaacaactacgtctcctggtaccagggcctccccggcaccgcccccaagctcctcatctacgagaacaacaagcgcccctccggcatccccgaccgcttctccggcgccaagtccggcaccgccgccaccctcgccatcaccggcctccagaccggcgacgaggccgactactactgcgccacctggtccggctccctcaacttcggcaccggcaccaaggtcaccgtcctc

SEQ ID NO: 17817 - RNA, 321 nt, synthetic construct
  misc_feature 1..321: note = derived and/or modified sequence opt2 from anti-HIV_119-001552_VR-Chain
  source 1..321: mol_type = other RNA
cagtccgtcctcacccagcccccctccgtctccgccgcccccggccagaaggtcaccatctcctgctccggctccaactcctacctcggcaacaagtacgtctcctggtaccagcagttccccggcaccgcccccaagctcctcatctacgagaacaacaagcgcccctccggcatccccgaccgcttctccgcctccaagtccgccgcctccgccaccctcgccatcaccggcctccagaccggcgacgagggcgactactactgcgccacctggaccggctccctcaacatcggcaccggcaccaaggtcaccgtcctc

SEQ ID NO: 17818 - RNA, 333 nt, synthetic construct
  misc_feature 1..333: note = derived and/or modified sequence opt2 from anti-HIV_059-188169_VR-Chain
  source 1..333: mol_type = other RNA
cagtccgtcctcacccagcccccctccgtctccgccgcccccggccagaaggtcaccatctcctgctccggctccacctccaacatcggcgacaactacgtctcctggtaccagcaggtccccggcaccgcccccaagctcctcatctacgagaacaaccgccgcccctccggcacccccgaccgcttctccggctccaagtccggcacctccgccaccctcgccatcaccggcctccagaccggcgacgaggccgactactactgcggcacctgggacacctccctctccaccggcggcgtcttcggcaccggcaccaaggtcaccgtcctc

SEQ ID NO: 17819 - RNA, 333 nt, synthetic construct
  misc_feature 1..333: note = derived and/or modified sequence opt2 from anti-HIV_059-183739_VR-Chain
  source 1..333: mol_type = other RNA
cagtccgtcctcacccagcccccctccgtctccgccgcccccggccagaaggtcaccatctcctgctccggctccacctccaacatcggcaagaactacgtctcctggtaccagcagctccccggcaccgcccccaagctcctcatctacgagaacaaccgccgcccctccggcacccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17820 - RNA, 333 nt, synthetic construct
  misc_feature 1..333: note = derived and/or modified sequence opt2 from anti-HIV_059-182376_VR-Chain
  source 1..333: mol_type = other RNA
cagtccgtcctctcccagcccccctccgtctccgccgcccccggccagaaggtcaccatctcctgctccggctcctcctccaacatcggcaactactacgtctcctggtaccagcagttccccggcaccgcccccaagctcctcatctacaagaacgacaaccgcccctccggcatccccgaccgcttctccggctccaagtccggcacctccgccaccctcggcatctccggcctccagaccggcgacgaggccgactactactgcggcacctggggcacctccctctccggcggcggcgtcttcggcaccggcaccaaggtcaccgtcctc

SEQ ID NO: 17821 - RNA, 333 nt, synthetic construct
  misc_feature 1..333: note = derived and/or modified sequence opt2 from anti-HIV_059-182199_VR-Chain
  source 1..333: mol_type = other RNA
cagtccgtcctcacccagcccccctccgtctccgccgcccccggccagaacatcaccatctcctgctccggctcctcctccaacatcggctcccactccatctcctggtaccagcacctccccggcaccgcccccaagatcgtcatctacgacaacgacaagcgccccctcggcatccccgaccgcttctccggctccaagtccggcacctccgccaccctcggcatcaccggcctccagaccggcgacgaggccgactactactgcggcacctgggacacctccctctccggcggcggcgtcttcggccccggcaccaaggtcaccgtcctc

SEQ ID NO: 17822 - RNA, 324 nt, synthetic construct
  misc_feature 1..324: note = derived and/or modified sequence opt2 from anti-HIV_059-169202_VR-Chain
  source 1..324: mol_type = other RNA
cactccgtcctcacccagcccccctccgtctccgccgcccccggccagaaggtcaccatctcctgctccggctcctcctccaagatcggcaacaacttcgtctcctggtaccagcagctccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcggcacctgggacggccgcgtctccgtcatcggctccggcaccaagctcaccgtcctc

SEQ ID NO: 17823 - RNA, 324 nt, synthetic construct
  misc_feature 1..324: note = derived and/or modified sequence opt2 from anti-HIV_059-155645_VR-Chain
  source 1..324: mol_type = other RNA
cagtccgccctcacccagcccgcctccgtctccggctcccccggccagtccatcaccatctcctgcaccggcacctcctccgacgtcggctacaactacgtctcctggtaccagcagctccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcggcacctgggacggccgcctctccgtcatcggcaccggcaccaaggtcaccgtcctc

SEQ ID NO: 17824 - RNA, 333 nt, synthetic construct
  misc_feature 1..333: note = derived and/or modified sequence opt2 from anti-HIV_059-151619_VR-Chain
  source 1..333: mol_type = other RNA
cagtccgtcctcacccagcccccctccgtctccgccgcccccggccagaaggtcaccatctcctgctccggctcctcctccaacatcggcaacaacttcgtctcctggtaccagctcctccccggcaccccccccaagctcctcatcttcaagaacaacgagcgcccctccggcatccccgaccgcttctccggctccaagtccggcacctccgccaccctcggcatcaccggcctccagaccggcgacgagggcgactactactgcggcacctgggacacctccctctccggcggcggcgtcttcggcaccggcacccgcgtcaccgtcctc

SEQ ID NO: 17825 - RNA, 333 nt, synthetic construct
  misc_feature 1..333: note = derived and/or modified sequence opt2 from anti-HIV_059-146503_VR-Chain
  source 1..333: mol_type = other RNA
cagtccgtcctcacccagcccccctccgtctccgccacccccggccagaaggtcaccatctcctgctccggctccgcctccaacatcggcaacaactacgtctcctggtaccagcagttccccggcaccgcccccaagctcctcatctacgacaccaacaagcgcccctccggcatccccgaccgcttctccggctccaagtccggcacctccgccatcctcggcatcaccggcctccagatcggcgacgaggccgactactactgcggcacctgggacacctccctctccggcggcggcgtcttcggcaccggcaccaaggtcaccgtcctc

SEQ ID NO: 17826 - RNA, 324 nt, synthetic construct
  misc_feature 1..324: note = derived and/or modified sequence opt2 from anti-HIV_059-136098_VR-Chain
  source 1..324: mol_type = other RNA
cagtccgtcctcacccagcccccctccgtctccgccgcccccggccagcgcgtcaccatctcctgctccggctcctcctccaacatcggcaacaactacgtctcctggtaccagcagctccccggcaccgcccccaagctcctcatctacgagaacaaccgccgcccctccggcatccccgaccgcttctccggctccaagtccggcacctccgccaccctcgccatcaccggcctccagaccggcgacgagggcgactactactgcgcccgctgggacggccgcctctccgtcatcggctccggcaccaaggtcaccgtcctc

SEQ ID NO: 17827 - RNA, 333 nt, synthetic construct
  misc_feature 1..333: note = derived and/or modified sequence opt2 from anti-HIV_059-105516_VR-Chain
  source 1..333: mol_type = other RNA
cagtccgccctcacccagcccccctccgtctccgccgcccccggccagaaggtcaccatctcctgctccggctcctcctccaacatcggcaacaactacgtctcctggtaccagcagctccccggcaccgcccccaagctcctcatctacgacaacaacaagcgcccctccggcatccccgaccgcttctccggctccaagtccggcacctccgccaccctcgccatcgccggcctccagaccggcgacgaggccaactactactgcggcacctgggacggctccctccgcaccggcggcgtcttcggcaccggcaccaaggtcaccgtcctc

SEQ ID NO: 17828 - RNA, 333 nt, synthetic construct
  misc_feature 1..333: note = derived and/or modified sequence opt2 from anti-HIV_059-095709_VR-Chain
  source 1..333: mol_type = other RNA
cagtccgtcctcacccagcccccctccgtctccgccgcccccggccagaaggtcaccatctcctgctccggccgctcctccaacatcggcaacaacttcgtctcctggtaccagctcctccccggcaccgcccccaagctcctcatctacaagaacaacgagcgcccctccggcatccccgaccgcttctccgcctccaagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 17829 - RNA, 333 nt, synthetic construct
  misc_feature 1..333: note = derived and/or modified sequence opt2 from anti-HIV_059-069468_VR-Chain
  source 1..333: mol_type = other RNA
cagtccgtcctcacccagcccccctccgtctccggcgccccccgccagtccgtcatcatctcctgcaccggctcctcctccaacatcggcggcttcgacgtccactggtaccagcagctccccggcaccgcccccaagctcctcatctacgagaacaaccgccgcccctccggcacccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 17830 - RNA, 333 nt, synthetic construct
  misc_feature 1..333: note = derived and/or modified sequence opt2 from anti-HIV_059-060026_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgtccccaagctcctcatctacaagaacgacaagcgcccctccggcatccccgaccgcttctccggctccaagtccgccacctccgccaccctcggcatcaccggcctccagaccggcgacgaggccgactactactgcggcatctgggacacctccctctccgccggcggcgtcttcggcaccggcacccgcgtcaccgtcctc

SEQ ID NO: 17831 - RNA, 333 nt, synthetic construct
  misc_feature 1..333: note = derived and/or modified sequence opt2 from anti-HIV_059-053668_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgctcctccggcatccccgaccgcttctccggctccaagtccggcacctccgccaccctcgccatcaccggcctccagaccggcgacgaggccgactactactgcggcacccgcgactcctccctctccggcggcggcgtcatcggcaccggcaccaaggtcaccgtcctc

SEQ ID NO: 17832 - RNA, 333 nt, synthetic construct
  misc_feature 1..333: note = derived and/or modified sequence opt2 from anti-HIV_059-052864_VR-Chain
  source 1..333: mol_type = other RNA
cagtccgtcctcacccagcccccctccctctccgccgcccccggccagcgcgtcaccatctcctgctccggctcctcctccaacatcggcaacaactacgtctcctggtaccagcagctccccggcaccgcccccaagctcctcatctacgagtccaacaagcgcccctccggcacccccgaccgcttctccggctccaagtccggcacctccgccaccctcgccatcaccggcctccagaccggcgacgaggccgactactactgcggcacctgggacgcctccctctcctccggcggcgtcatgggcaccggcaccaaggtcaccgtcctc

SEQ ID NO: 17833 - RNA, 333 nt, synthetic construct
  misc_feature 1..333: note = derived and/or modified sequence opt2 from anti-HIV_059-050968_VR-Chain
  source 1..333: mol_type = other RNA
cagtccgtcctcacccaggccccctccgtctccgccgcccccggcgagaaggtcaccatctcctgctccggcacctcctccaacatcggctactactacgtctcctggtaccagcagttccccggcaccgcccccaaggtcgtcatctacgagaacaaccgccgcccctccggcacccccgaccgcttctccggctccaagtccggcacctccgccaccctcgccatcaccggcctccagaccggcgacgaggccgactactactgcggcacctggggcggctccctctccaccggcggcgtcatcggcaccggcaccaaggtcaccgtcctc

SEQ ID NO: 17834 - RNA, 333 nt, synthetic construct
  misc_feature 1..333: note = derived and/or modified sequence opt2 from anti-HIV_059-046422_VR-Chain
  source 1..333: mol_type = other RNA
cagtccgtcctcacccagcccccctccgtctccgccgcccccggccagaaggtcaccatctcctgctccggctcctcctccaccatcggcaacaactacatctcctggtaccagctcctccccggcaccccccccaactacctcatcttcaagatctccgagcgcccctccggcgtccccgaccgcttctccggctccaagtccggcacctccgccaccctccacatcaccggcctccagaccggcgacgagggcgactactactgcggcacctgggacacctccctctccggcggcggcgtcttcggcaccggcaccaaggtcaccgtcctc

SEQ ID NO: 17835 - RNA, 333 nt, synthetic construct
  misc_feature 1..333: note = derived and/or modified sequence opt2 from anti-HIV_059-045120_VR-Chain
  source 1..333: mol_type = other RNA
cagtccgtcctcacccagcccccctccgtctccgccgcccccggccagaaggtcgccatctcctgctccggctcctcctccaccatcggcaacaactacgtctcctggtaccagctcctccccggcaccccccccaagctcctcatcttcaagtcccacgagcgcccctccggcatccccgaccgcttctccggctccaagtccggcacctccgccaccctcggcatcaccggcctccagaccggcgacgagggcgactactactgcggcacctgggactcctccctctccgtcggcggcgtcttcggcaccggcaccaaggtcaccgtcctc

SEQ ID NO: 17836 - RNA, 333 nt, synthetic construct
  misc_feature 1..333: note = derived and/or modified sequence opt2 from anti-HIV_059-039932_VR-Chain
  source 1..333: mol_type = other RNA
cagtccgtcctcacccagcccccctccgtctccgccgcccccggccagaaggtcaccatctcctgctccggctcctcctccatcatcggcaagaactacgtctcctggtaccagcacctccccggcaccgcccccaagctcctcatctacgagaacaacaagcgcccctccggcatccccgaccgcttctccggctccaagtccggcacctccgccaccctcgccatcgccggcctccagaccggcgacgaggccaactactactgcggcacctggggcggctccctctccaccggcggcgtcttcggcaccggcaccaaggtcaccgtcctc

SEQ ID NO: 17837 - RNA, 333 nt, synthetic construct
  misc_feature 1..333: note = derived and/or modified sequence opt2 from anti-HIV_059-038595_VR-Chain
  source 1..333: mol_type = other RNA
cagtccgtcctcacccagcccccctccgtctccgccgcccccggccagaaggtcaccatctcctgctccggccgctcctccaacatcggcaacaacttcgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcatcgtcctc

SEQ ID NO: 17838 - RNA, 333 nt, synthetic construct
  misc_feature 1..333: note = derived and/or modified sequence opt2 from anti-HIV_059-035082_VR-Chain
  source 1..333: mol_type = other RNA
cagtccgtcctcacccagcccccctccgtctccgccgcccccggccagaaggtcaccatctcctgctccggctccacctccaacatcggcaagtccttcgtctcctggtaccagcagctccccggcaccgcccccaagctcctcatctacgacaacaaccgccgcccctccggcacccccgaccgcttctccggctccaagtccggcacctccgccaccctcgccatcaccggcctccagaccggcgacgaggccgactactactgcggcacctggggcggctccctctccaccggcggcgtcatcggcaccggcaccaaggtcaccgtcctc

SEQ ID NO: 17839 - RNA, 333 nt, synthetic construct
  misc_feature 1..333: note = derived and/or modified sequence opt2 from anti-HIV_059-029204_VR-Chain
  source 1..333: mol_type = other RNA
cagtccgtcctcacccagcccccctccgtctccgccgcccccggccagaaggtcaccatctcctgctccggctccacctccaacatcggcaagatcctcgtctcctggtaccagcagctccccggcaccgcccccaagccctccatctacgacaacaaccgccgcccctccggcacccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcccc

SEQ ID NO: 17840 - RNA, 324 nt, synthetic construct
  misc_feature 1..324: note = derived and/or modified sequence opt2 from anti-HIV_059-025235_VR-Chain
  source 1..324: mol_type = other RNA
cagtccgtcctcacccagcccccctccgtctccggcgcccccggccagaagatcaccatctcctgctccggctccacctccaacatcggcaagtcctacgtctcctggtaccagcagctccccggcaccgcccccaagctcctcatctacgagaacaaccgccgcccctccggcacccccgaccgcttctccggctccaagtccggcacctccgccaccctcgccatcaccggcctccagaccggcgacgaggccgactactactgcggcacctgggacggctccggcggcgtcatcggcaccggcaccaaggtcaccgtcctc

SEQ ID NO: 17841 - RNA, 333 nt, synthetic construct
  misc_feature 1..333: note = derived and/or modified sequence opt2 from anti-HIV_059-015192_VR-Chain
  source 1..333: mol_type = other RNA
cagtccgtcctcacccagcccccctccgtctccgccgcccccggccagaaggtcaccatctcctgctccggctcctcctccaccatcggcgacaagtacgtctcctggtaccagctcctccccggcaccgcccccaagctcctcatctacaagaacaacaagcgcccctccggcatccccgaccgcttctccggctccaagtccggcacctccgccaccctcggcatcaccggcctccagaccggcgacgaggccgactactactgcggcacctgggacacctccctctccgtcggcggcgtcttcggcaccggcaccaaggtcaccgtcctc

SEQ ID NO: 17842 - RNA, 333 nt, synthetic construct
  misc_feature 1..333: note = derived and/or modified sequence opt2 from anti-HIV_059-007060_VR-Chain
  source 1..333: mol_type = other RNA
cagtccgtcctcacccagcccccctccgtctccgccgcccccggccagaaggtcaccatctcctgctccggctcctcctccaacatcggcaacaagtacgtctcctggtaccagcagctccccggcaccgcccccaagctcctcatctacgagaacaagaagcgcccctccggcatccccgaccgcttctccggctccaagtccggcacctccgccaccctcggcatcaccggcctccagaccggcgacgaggccgactacttctgcggcacctgggacacctccctctccggcggcggcgtcttcggctccggcaccaaggtcaccgtcctc

SEQ ID NO: 17843 - RNA, 324 nt, synthetic construct
  misc_feature 1..324: note = derived and/or modified sequence opt2 from anti-HIV_059-006953_VR-Chain
  source 1..324: mol_type = other RNA
cagtccgtcctcacccagcccccctccgtctccgccgcccccggccagaaggtcaccatctcctgctccggctcctcctccaacatcggcgtctcctggtaccagcaggtccccggcaccgcccccaagctcctcatctacgacaacgacaagcgccccaccggcatccccgaccgcttctccggctccaagtccggcacctccgccatcctcgccatcaccggcctccagaccggcgacgagggcgactactactgcggcacctgggagacctccctctccggcggcggcgtcttcggcaccggcaccaaggtcaccgtcctc

SEQ ID NO: 17844 - RNA, 333 nt, synthetic construct
  misc_feature 1..333: note = derived and/or modified sequence opt2 from anti-HIV_059-005953_VR-Chain
  source 1..333: mol_type = other RNA
cactccgtcctcacccagcccccctccgtctccgccgcccccggccagaaggtcaccatctcctgctccggcacctcctccaacatcggcaagaactacgtctcctggtaccagcagctccccggcaccgcccccaagctcctcatctacgagaacaaccgccgcccctccggcacccccgaccgcttctccggctccaagtccggcacctccgccaccctcgccatcaccggcctccagaccggcgacgaggccgactactactgcggcacctgggacacctccctctccaccggcggcgtcttcggcaccggcaccaaggtcaccgtcctc

SEQ ID NO: 17845 - RNA, 324 nt, synthetic construct
  misc_feature 1..324: note = derived and/or modified sequence opt2 from anti-HIV_059-003725_VR-Chain
  source 1..324: mol_type = other RNA
cagtccgtcctcacccagcccccctccgtctccgccgcccccggccagaagctcaccatctcctgctccggctccacctccaagatcggcaacaactacgtctcctggtaccagcacctccccggcaccgcccccaagctcctcgtctacgagaacaacaagcgcccctccggcatccccgaccgcttctccggctccaagtccggcacctccgccaccctcgccatcaccggcctccagaccggcgacgaggccgactactactgcggcacctgggacggccgcctctccgtcatcggcaccggcaccaaggtcaccgtcctc

SEQ ID NO: 17846 - RNA, 333 nt, synthetic construct
  misc_feature 1..333: note = derived and/or modified sequence opt2 from anti-HIV_059-002618_VR-Chain
  source 1..333: mol_type = other RNA
cagctcgtcctcacccagcccccctccgtctccgccgcccccggccagaaggtcaccatctcctgctccggctcctcctccaacatcggcaacaacttcgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacccgcctctccgccggcggcgtcttcggcaccggcaccaaggtcaccgtcctc

SEQ ID NO: 17847 - RNA, 324 nt, synthetic construct
  misc_feature 1..324: note = derived and/or modified sequence opt2 from anti-HIV_059-001522_VR-Chain
  source 1..324: mol_type = other RNA
cagtccgtcctcacccagcccccctccgtctccgccgcccccggccagaaggtcaccatctcctgctccggctccaactccaacatcggcaacaactacgtctcctggtaccagcagctccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcggcacctgggacggccgcctctccgtcatcggcgccggcaccaaggtcatcgtcgtc

SEQ ID NO: 17848 - RNA, 333 nt, synthetic construct
  misc_feature 1..333: note = derived and/or modified sequence opt2 from anti-HIV_059-000731_VR-Chain
  source 1..333: mol_type = other RNA
cagtccgtcctcacccagcccccctccgtctccgccgcccccggccagaaggtcaccatctcctgctccggctccacctccaacatcggcaacaagtacgtctcctggtaccagcaggtccccggcaccgcccccaagctcctcatctacgagaacaaccgccgcccctccggcatccccgaccgcttctccggctccaagtccggcacctccgccaccctcgccatcaccggcctccagaccggcgacgaggccgactactactgcggcacctgggacgcctccctccgcaccggcggcgtcatcggcaccggcaccaaggtcaccgtcctc

SEQ ID NO: 17849 - RNA, 333 nt, synthetic construct
  misc_feature 1..333: note = derived and/or modified sequence opt2 from anti-HIV_059-000634_VR-Chain
  source 1..333: mol_type = other RNA
cagtccgtcctcacccagcccccctccgtctccgccgcccccggccagaaggtcaccatctcctgctccggctcctcctccaccatcggcaacaactacgtctcctggtaccaggtcgtccccggcaccgcccccaagctcctcatctacaagatcaacgagcgcccctccggcatccccgaccgcttctccggctccaagtccggcacctccgccaccctcggcatcaccggcctccagaccggcgacgaggccgactactactgcggcacctgggacacctccctctccggcggcggcgtcttcggccccggcaccaaggtcaccgtcctc

SEQ ID NO: 17850 - RNA, 333 nt, synthetic construct
  misc_feature 1..333: note = derived and/or modified sequence opt2 from anti-HIV_048-250757_VR-Chain
  source 1..333: mol_type = other RNA
cagtccgtcctcacccagcccccctccgtctccggcgcccccggccagcgcgtcaccatctcctgcaccggcaccacctccaacatcggctccaactacgtcgcctggtaccagcagctccccggcaccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17851 - RNA, 333 nt, synthetic construct
  misc_feature 1..333: note = derived and/or modified sequence opt2 from anti-HIV_048-250716_VR-Chain
  source 1..333: mol_type = other RNA
cagtccgtcctcacccagcccccctccgtctccgccgcccccggccagaaggtcaccatctcctgctccggctcctcctccaacatcggcaacaagtacgtctcctggtaccagcagctccccggcaccgcccccaagctcctcatctacgagaactccaagcgcccctccggcatccccgaccgcttctccggctccaagtccggcacctccgccaccctcggcatcaccggcctccagaccggcggccaggccgactactactgcggcacctgggacacctccctctccgccggcggcgtcttcggctccggcaccaaggtcaccgtcctc

SEQ ID NO: 17852 - RNA, 333 nt, synthetic construct
  misc_feature 1..333: note = derived and/or modified sequence opt2 from anti-HIV_048-250463_VR-Chain
  source 1..333: mol_type = other RNA
cagtccgtcctcacccagcccccctccgtctccgccgcccccggccagaaggtcaccatctcctgctccggctcccgctccaacaacggcaacaactacgtctcctggtaccagcagctccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcggcacctgggactcctccctctccggcggcggcgtcatcggcaccggcaccaagctcaccgtcctc

SEQ ID NO: 17853 - RNA, 333 nt, synthetic construct
  misc_feature 1..333: note = derived and/or modified sequence opt2 from anti-HIV_048-248153_VR-Chain
  source 1..333: mol_type = other RNA
cagtccgccctcacccagcccgcctccgtctccgcctccttcggccagtccatcaccatctcctgcaccggcgccgcctccgacgtcggctacaactacgtctcctggtaccagcagctccccggcaccacccccaagctcctcatctaccgcaacaaccagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17854 - RNA, 333 nt, synthetic construct
  misc_feature 1..333: note = derived and/or modified sequence opt2 from anti-HIV_048-247532_VR-Chain
  source 1..333: mol_type = other RNA
cagtccgtcctcacccagcccccctccgtctccgccgcccccggccagcaggtcaccatctcctgctccggcaccacctccaacatcggcaccaactacgtctcctggtaccagcagatgccccccgccgcccccaagctcctcatctacgacaacaagaagcgcccctccgacatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17855 - RNA, 333 nt, synthetic construct
  misc_feature 1..333: note = derived and/or modified sequence opt2 from anti-HIV_048-245846_VR-Chain
  source 1..333: mol_type = other RNA
cagtccgtcctcacccagcccccctccgtctccgccacccccggccagcgcgtcaccatctcctgcaccggctcctcctccaacatcggcggctacgacgtctcctggtaccaggtcctccccggcaccgcccccaagctcctcatctacgactccgacaagcgcccctccggcatccccgaccgcttctccggctcccagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 17856 - RNA, 333 nt, synthetic construct
  misc_feature 1..333: note = derived and/or modified sequence opt2 from anti-HIV_048-244016_VR-Chain
  source 1..333: mol_type = other RNA
cagtccgtcctcacccagcccccctccgtctccggcgcccccggccagcgcgtcaccatctcctgcaccggctcctcctccaacatcggcggctacgacgtccactggtaccagcagctccccggcaccgcccccaagctcctcatctacaagaacgacaagcgcccctccggcatccccgaccgcttctccggctccaagtccggcacctccgccatcctcggcatcaccggcctccagaccggcgacgaggccgactactactgcggcgcctgggacacctccctctccgccggcggcgtcttcggcaccggcaccaaggtcaccgtcctc

SEQ ID NO: 17857 - RNA, 333 nt, synthetic construct
  misc_feature 1..333: note = derived and/or modified sequence opt2 from anti-HIV_048-243682_VR-Chain
  source 1..333: mol_type = other RNA
cagtccctcctcacccagcccccctccgtctccgccgcccccggccagaaggtcaccatctcctgcaccggctcctcctccaacatcggcggctacgacgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17858 - RNA, 333 nt, synthetic construct
  misc_feature 1..333: note = derived and/or modified sequence opt2 from anti-HIV_048-243588_VR-Chain
  source 1..333: mol_type = other RNA
cagtccctcctcacccagcccccctccgtctccgccccccccggccagatggtctccatctcctgctccggctcctcccacaacatcggcgacaactacgtctcctggtaccagcacctccccggcaccgcccccaagctcctcatctacgacaacaactcccgcccctccggcatccccgaccgcttctccggctccaagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 17859 - RNA, 333 nt, synthetic construct
  misc_feature 1..333: note = derived and/or modified sequence opt2 from anti-HIV_048-241775_VR-Chain
  source 1..333: mol_type = other RNA
cagtccgtcctcgcccagcccccctccgtctccggcgcccccggccagcgcgtcaccatctcctgcaccggctcctcctccaacatcggcgagtacgacgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17860 - RNA, 333 nt, synthetic construct
  misc_feature 1..333: note = derived and/or modified sequence opt2 from anti-HIV_048-237996_VR-Chain
  source 1..333: mol_type = other RNA
cagtccgtcctcacccagcccccctccgtctccggcgcccccggccagcgcgtcaccatctcctgcaccggctcctcctccaacatcggcggctacgacgtccactggtaccgccagctccccggcaccgcccccaagctcctcatctacgacaccgtcaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17861 - RNA, 330 nt, synthetic construct
  misc_feature 1..330: note = derived and/or modified sequence opt2 from anti-HIV_048-237730_VR-Chain
  source 1..330: mol_type = other RNA
tccgtcctcacccagcccccctccgtctccggcgcccccggccagcgcgtcaccatctcctgcaccggcaccaactccaacttcggctccaactacgcccactggtaccagcaggtccccggcaccgcccccaagctcctcatctactccaacaacgcccgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17862 - RNA, 333 nt, synthetic construct
  misc_feature 1..333: note = derived and/or modified sequence opt2 from anti-HIV_048-237253_VR-Chain
  source 1..333: mol_type = other RNA
cagtccgtcctcacccagcccccctccgtctccgccgcccccggccagaaggtcaccgtctcctgctccggctcctcctccaacatcggctccaacgacgtctcctggtaccagcagttccccggcgccgcccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17863 - RNA, 333 nt, synthetic construct
  misc_feature 1..333: note = derived and/or modified sequence opt2 from anti-HIV_048-234100_VR-Chain
  source 1..333: mol_type = other RNA
cagtccatgctcacccagcccccctccgtctccgccgcccccggcgagaaggtcaccatctcctgctccggctcctcctccaacatcggcaagaccttcgtctcctggtaccagcaggtccccggcaccgcccccaagctcctcatctacaagaacgacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17864 - RNA, 333 nt, synthetic construct
  misc_feature 1..333: note = derived and/or modified sequence opt2 from anti-HIV_048-230882_VR-Chain
  source 1..333: mol_type = other RNA
cagtccgtcctcacccagcccccctccgtctccgccgcccccggccagaaggtcaccatctcctgctccggcaactcctccaacatcggctccaacttcgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctcccccggcggcgtcttcggcaccggcaccaaggtcaccgtcctc

SEQ ID NO: 17865 - RNA, 333 nt, synthetic construct
  misc_feature 1..333: note = derived and/or modified sequence opt2 from anti-HIV_048-229473_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagttccccggcaccgcccccaagctcctcatctacgagaacaacaagcgcccctccggcatccccgaccgcttctccggctccaagtccggcaccaccgccaccctcgccatcacccgcctccagaccggcgacgaggccgactactactgcggcacctggggcggctccctctccgccggcggcgtcttcggcaccggcaccaaggtcaccgtcctc

SEQ ID NO: 17866 - RNA, 333 nt, synthetic construct
  misc_feature 1..333: note = derived and/or modified sequence opt2 from anti-HIV_048-228238_VR-Chain
  source 1..333: mol_type = other RNA
cagtccgtcctcacccagcccccctccgtctccgccgcccccggccagaaggtcaccatctcctgctccggctcctcctccaacatcggcatcaactacgtctcctggtaccagcagctccccggcaccgcccccaagctcctcatctacgacaacaccaagcgcccccagggcatccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 17867 - RNA, 333 nt, synthetic construct
  misc_feature 1..333: note = derived and/or modified sequence opt2 from anti-HIV_048-228027_VR-Chain
  source 1..333: mol_type = other RNA
cagtccctcctcacccagtccccctccgcctccggcccccccggccagcgcgtcaccatctcctgctccggctccaactccaacatcggctccaacaccgtcaactggtaccaccacctccccggcgccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17868 - RNA, 333 nt, synthetic construct
  misc_feature 1..333: note = derived and/or modified sequence opt2 from anti-HIV_048-227795_VR-Chain
  source 1..333: mol_type = other RNA
cagtccgtcctcacccagcccccctccgtctccgccgcccccggccagaaggtcaccatctcctgctccggctcctcctccaacatcgagtcccgctccgtccactggtaccagcagaagcccggccaggcccccgtcctcgtcatctactacgactccgaccgcccctccggcatccccgaccgcttctccggctccaagtccggcaccgccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17869 - RNA, 333 nt, synthetic construct
  misc_feature 1..333: note = derived and/or modified sequence opt2 from anti-HIV_048-227770_VR-Chain
  source 1..333: mol_type = other RNA
cagtccgtcctcacccagcccccctccgtctccggcgcccccggccagcgcgtcaccatctcctgcaccggctcctcctccaacatcggcccccgcgacgtccactggtaccagcagctccccggcaccgtccccaagctcctcatctacgacacctacacccgcccctccggcatccccgaccgcttctccggctccaagtccggcgcctccgccaccctcgacatcaccggcctccagaccggcgacgaggccgactactactgcggcatctgggacacctccctctccgccggcggcgtcttcggcaccggcaccaaggtcaccgtcctc

SEQ ID NO: 17870 - RNA, 333 nt, synthetic construct
  misc_feature 1..333: note = derived and/or modified sequence opt2 from anti-HIV_048-225298_VR-Chain
  source 1..333: mol_type = other RNA
cagtccgccctcacccagccccgctccgtctccggctcccccggccagtccgtcaccatctcctgcaccggcacctccaacgacgtcggctacgactacgtctcctggtaccagcagctccccggcaccgcccccaagctcctcatctacgacatcaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17871 - RNA, 327 nt, synthetic construct
  misc_feature 1..327: note = derived and/or modified sequence opt2 from anti-HIV_048-225090_VR-Chain
  source 1..327: mol_type = other RNA
gagctcacccagcccccctccgtctccggcgcccccggccagcgcgtcaccatctcctgcaccggctcctcctccaacatcggcggctacgacgtccactggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 17872 - RNA, 333 nt, synthetic construct
  misc_feature 1..333: note = derived and/or modified sequence opt2 from anti-HIV_048-224187_VR-Chain
  source 1..333: mol_type = other RNA
cagtccgtcctcacccagcccccctccgcctccggcacccccggccagcgcgtcaccatctcctgctccggctcctccgccaacatcggcaccaactacgtcttctggtaccagcacctccccggcaccaccccccgcctcctcatcttccgcaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17873 - RNA, 333 nt, synthetic construct
  misc_feature 1..333: note = derived and/or modified sequence opt2 from anti-HIV_048-223055_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagttccccggcaccgcccccaaggtcctcatctacggcaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17874 - RNA, 333 nt, synthetic construct
  misc_feature 1..333: note = derived and/or modified sequence opt2 from anti-HIV_048-222711_VR-Chain
  source 1..333: mol_type = other RNA
cagcccgtcctcacccagcccccctccgtctccggcgcccccggccagcgcgtcaccatctcctgcaccggctcctcctccaacatcggcggctacgacgtccactggtaccagcaggtccccggcaccgcccccaagctcctcatcttcgagaacaaccgccgcccctccggcatccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 17875 - RNA, 333 nt, synthetic construct
  misc_feature 1..333: note = derived and/or modified sequence opt2 from anti-HIV_048-221209_VR-Chain
  source 1..333: mol_type = other RNA
cagtccgtcctcacccagcccccctccgtctccggcgcccccggccagcgcgtcaccatctcctgcaccggcaactcctccaacatcggcgactacgacgtccactggtaccagcaggtcgccggcaccgcccccaagctcctcatcttcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17876 - RNA, 333 nt, synthetic construct
  misc_feature 1..333: note = derived and/or modified sequence opt2 from anti-HIV_048-220629_VR-Chain
  source 1..333: mol_type = other RNA
cagtccgccctcacccagcccgcctccgtctccggctccctcggccagtccatcaccatctcctgcaccggcacctcccgcgacgtcggctactcctacgtctcctggtaccagcacctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17877 - RNA, 333 nt, synthetic construct
  misc_feature 1..333: note = derived and/or modified sequence opt2 from anti-HIV_048-219430_VR-Chain
  source 1..333: mol_type = other RNA
cagtccgtcctcacccagcccccctccgtctccgccgcccccggccagatggtcaccatctcctgctccggctccacctccaacatcggcatcaactacgtctcctggtaccagcacgtccccggcaccgcccccaagctcctcatctacgacaacaacaagcgcccctccggcatccccgaccgcttctccggctccaagtccggcacctccgccaccctcggcatcaccggcctccacaccggcgacgaggccgactactactgcggcacctgggacacctccctctccgccggcggcgtcttcggcaccggcaccaaggtcaccgtcctc

SEQ ID NO: 17878 - RNA, 333 nt, synthetic construct
  misc_feature 1..333: note = derived and/or modified sequence opt2 from anti-HIV_048-216250_VR-Chain
  source 1..333: mol_type = other RNA
cagtccgtcctcacccagcccccctccgtctccgccgcccccggccagaaggtcaccatctcctgcaccggcaccacctccgacttcggctacaactgcgtctcctggtaccagcagcaccccggccgcgcccccaaggtcatcatctccggcgtcaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17879 - RNA, 321 nt, synthetic construct
  misc_feature 1..321: note = derived and/or modified sequence opt2 from anti-HIV_048-216133_VR-Chain
  source 1..321: mol_type = other RNA
acccagcccccctccctctccgccacccccggccagcgcgtctccatctcctgctccggcggcggctccaacatcggcaacaacgacgtcttctggttccagcagttccccggcgccggcccccgcctcctcatctacgacaaccacaagcgccactacggcacccccgaccgcttctccggctccaagtccggcacctccgccaccctcgccatcaccggcctccagaccggcgacgaggccgcctactactgcggcacctgggacggctccctctccaccggcggcgtcatcggcaccggcaccaaggtcaccgtcctc

SEQ ID NO: 17880 - RNA, 333 nt, synthetic construct
  misc_feature 1..333: note = derived and/or modified sequence opt2 from anti-HIV_048-214886_VR-Chain
  source 1..333: mol_type = other RNA
cagtccgccctcacccagccccgctccgtctccggctcccccggccagtccgtcaccatctcctgcaccggcacctcctccgacgtcggctacaactacgtctcctggtaccagcaccaccccggcaccgcccccaagctcctcatctacaagaacaacaaccgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17881 - RNA, 333 nt, synthetic construct
  misc_feature 1..333: note = derived and/or modified sequence opt2 from anti-HIV_048-214709_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacgaccgccgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17882 - RNA, 333 nt, synthetic construct
  misc_feature 1..333: note = derived and/or modified sequence opt2 from anti-HIV_048-214001_VR-Chain
  source 1..333: mol_type = other RNA
cagtccgtcctcacccagcccccctccgtctccggcgcccccggccagaccgtcaccatctcctgctccggctccaactccaacatcggcaaccacgacgtccactggtaccagcacgtccccggcaccgcccccaagctcctcatctacgacaacaacaagcgcccctccggcatccccgaccgcttctccggctccaagtccggcacctccgccaccctcggcatcaccggcctccagaccggcgacgaggccgagtactactgcgccacctgggacgcctccctctccggcggcggcgtcttccgcaccggcaccaaggtcaccgtcctc

SEQ ID NO: 17883 - RNA, 333 nt, synthetic construct
  misc_feature 1..333: note = derived and/or modified sequence opt2 from anti-HIV_048-213230_VR-Chain
  source 1..333: mol_type = other RNA
cagtccgtcctcacccagcccccctccatgtccgccgcccccggccagaaggtcaccatctcctgctccggctcctccaacaacatcggcaagaacgtcgtctcctggtaccagcagctccccggcaccgcccccaaggtcctcatctacgagaacaacaagcgcctctccggcatccccgaccgcttctccggctccaagtccggcacctccgccaccctcgtcatcaccggcctccagaccggcgacgaggccgactactactgcggcacctgggactcctccctctccgccggcggcgtcttcggcaccggcaccaaggtcaccgtcctc

SEQ ID NO: 17884 - RNA, 333 nt, synthetic construct
  misc_feature 1..333: note = derived and/or modified sequence opt2 from anti-HIV_048-212574_VR-Chain
  source 1..333: mol_type = other RNA
cagtccgtcctcacccagcccccctccgtctccgccgcccccggccagcgcgtcaccgtctcctgctccggctccacctccaacatcgagtccaactacgtctcctggtaccagcaggtccccggcaccgcccccaagctcctcatctacgagaacaacaagcgcccctccggcatccccgaccgcttctccggctccaagtccggcacctccgccaccctcgccatcaccggcctccagaccggcgacgaggccgcctactactgcggcacctgggacggctccctctccaccggcggcgtcatcggcaccggcaccaaggtcaccgtcctc

SEQ ID NO: 17885 - RNA, 333 nt, synthetic construct
  misc_feature 1..333: note = derived and/or modified sequence opt2 from anti-HIV_048-212207_VR-Chain
  source 1..333: mol_type = other RNA
cagtccgtcctcacccagcccccctccctctccgccgcccccggccagaaggtcaccatctcctgctccggcggctcctccaacatcggcaacaactacgtctcctggtaccagcacctccccggcaccgcccccaagctcctcatctacgacaactacaagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 17886 - RNA, 333 nt, synthetic construct
  misc_feature 1..333: note = derived and/or modified sequence opt2 from anti-HIV_048-209146_VR-Chain
  source 1..333: mol_type = other RNA
cagtccgtcctcacccagcccccctccgtctccggcgcccccggccagaagatcaccgtctcctgcaccggcaccacctccaacatcggcccccacgacgtccactggtaccagctcgtccccggccgcccccccaagctcctcatcttccacaacaacatccgcccctccggcatccccgaccgcttctccggctccaagtccggcatgtccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17887 - RNA, 333 nt, synthetic construct
  misc_feature 1..333: note = derived and/or modified sequence opt2 from anti-HIV_048-208206_VR-Chain
  source 1..333: mol_type = other RNA
cagtccgtcctcacccagcccccctccgtctccgccgcccccggccagaaggtcaccatctcctgctccggctcctcctccaacatcggctccaactacgtctcctggtaccagcagttccccggcaccgccccccgcctcctcatctacgagaacgacaagcgcccctccgccatccccgaccgcttctccggctccaagtccggcacctccgccaccctcggcatcaccggcctccacaccggcgacgaggccgactactactgcggcacctgggacggctccctctccaccggcggcgtcatcggcaccggcaccaaggtcaccgtcctc

SEQ ID NO: 17888 - RNA, 333 nt, synthetic construct
  misc_feature 1..333: note = derived and/or modified sequence opt2 from anti-HIV_048-208194_VR-Chain
  source 1..333: mol_type = other RNA
cagtccgccctcacccagcccccctccgcctccggctcccccggccagtccgtcaccatctcctgcaccggcacctcctccgacatcggctacaagtacgtctcctggtaccagctcctccccggcaccccccccaagctcctcatcttcaagaacaacgagcgcccctccggcatccccgaccgcttctccggctccaagtccggcacctccgccaccctcggcatcaccggcctccagaccggcgacgaggccgactactactgcggcgcctgggacacctccctctccgccggcggcgtcttcggcaccggcaccaaggtcaccgtcctc

SEQ ID NO: 17889 - RNA, 333 nt, synthetic construct
  misc_feature 1..333: note = derived and/or modified sequence opt2 from anti-HIV_048-207744_VR-Chain
  source 1..333: mol_type = other RNA
cagtccgccctcacccagcccgcctccgtctccgcctccttcggccagtccatcaccatctcctgcaccggcgccgcctccaccatcggcaacaacctcgtctcctggtaccgcctcctccccggcaccgcccccaagctcctcatctacaagaacgacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17890 - RNA, 333 nt, synthetic construct
  misc_feature 1..333: note = derived and/or modified sequence opt2 from anti-HIV_048-206501_VR-Chain
  source 1..333: mol_type = other RNA
cagtccgtcctcacccagcccccctccgtctccggcgcccccggccagcgcgtcaccatctcctgctccggctcctcctccaacatcggcaacaacgccgtcaactggtaccagcagctccccggcaaggcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17891 - RNA, 333 nt, synthetic construct
  misc_feature 1..333: note = derived and/or modified sequence opt2 from anti-HIV_048-204221_VR-Chain
  source 1..333: mol_type = other RNA
cagtccgtcctcacccagcccccctccgcctccggcacccccggccagcgcgtcaccatctcctgcttcggctcctcctccaacatcgcctcctccgccgtcaactggtaccagcagctccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17892 - RNA, 333 nt, synthetic construct
  misc_feature 1..333: note = derived and/or modified sequence opt2 from anti-HIV_048-204015_VR-Chain
  source 1..333: mol_type = other RNA
cagtccgtcctcacccagcccccctccgcctccggcacccccggccagcgcgtcaccatctcctgctccggctcctcctccaacatcggctccaagtacgtctactggtaccagcagctccccggcaccgcccccaagctcctcatctacaagaacgacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17893 - RNA, 333 nt, synthetic construct
  misc_feature 1..333: note = derived and/or modified sequence opt2 from anti-HIV_048-201240_VR-Chain
  source 1..333: mol_type = other RNA
cagtccgtcctcacccagcccccctccgtctccgccgcccccggccagaaggtcaccatctcctgctccggctcctcctccaacatcggcaacaactacgtcgcctggtaccagcagctccccggcaccgcccccaagctcctcatcaaggagaactcccagcgcccctccggcatccccgaccgcttctccggctccaagtccggcacctccgccaccctcgccatcaccggcctccagaccggcgacgaggccgactactactgcggcacctgggacacctccctctccaccggcggcgtcttcggcaccggcaccaaggtcaccgtcctc

SEQ ID NO: 17894 - RNA, 333 nt, synthetic construct
  misc_feature 1..333: note = derived and/or modified sequence opt2 from anti-HIV_048-200455_VR-Chain
  source 1..333: mol_type = other RNA
cagtccgccctcacccagcccgcctccgtctccggctcccccggccagtccatcaccatctcctgcaccggcacctcctccgacgtcggctacaactacgtctcctggtaccaggtcctccccggcaccgcccccaagctcctcatctacaagaacaccgagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 17895 - RNA, 333 nt, synthetic construct
  misc_feature 1..333: note = derived and/or modified sequence opt2 from anti-HIV_048-200319_VR-Chain
  source 1..333: mol_type = other RNA
cagtccgtcgtcacccagcccccctccgcctccggcacccccggccagcgcgtcaccatctcctgctccggctcctcctccaacatcggctccaagtacgtctactggtaccaccagcaccccggcaccgcccccaagctcctcatctacgacaacaacaaccgcccctccggcatccccgaccgcttctccggctccaagtccggcacctccgccaccctcggcatcaccggcctccagaccggcgacgaggccgactactactgcggcacctgggacacctccctctcccgcggcggcgtcttcggcaccggcaccaaggtcaccgtcctc

SEQ ID NO: 17896 - RNA, 333 nt, synthetic construct
  misc_feature 1..333: note = derived and/or modified sequence opt2 from anti-HIV_048-197896_VR-Chain
  source 1..333: mol_type = other RNA
cagtccgtcctcacccagcccccctccgtctccgccgcccccggccagaaggtcaccatctcctgctccggcgcctcctacaacatcggcaagaactccgtctcctggtaccagcagctccccggcaccccccccaagctcctcatcttcaagaacaacgagcgcccctccggcatccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 17897 - RNA, 333 nt, synthetic construct
  misc_feature 1..333: note = derived and/or modified sequence opt2 from anti-HIV_048-193813_VR-Chain
  source 1..333: mol_type = other RNA
cagtccgtcctcacccagtccccctccgtctccgccgcccccggccagaaggtcaccatctcctgctccggctccaactccaacgtcggcaactactacgtctcctggtaccagcacctccccggcaccgcccccaaggtcctcatctacgagggcaacaagcgcccctccggcgtccccgaccgcttctccggctccaagtccggcacctccgcctccctcgccatcaccggcctccagaccggcgacgaggccgactactactgcggcacctgggacacctccctctccgccggcggcgtcttcggctccggcaccaaggtcaccgtcctc

SEQ ID NO: 17898 - RNA, 333 nt, synthetic construct
  misc_feature 1..333: note = derived and/or modified sequence opt2 from anti-HIV_048-192098_VR-Chain
  source 1..333: mol_type = other RNA
cagtccgtcctcacccagcccccctccgcctccggcacccccggccagcgcgtcaccatctcctgctccggctccacctccaacatcggctccaactacgtctactggtaccagcagctccccggcaccacccccaagctcctcatctacgagaacaacaagcgcccctccggcatcaccgaccgcttcttcggctccaagtccggcccctccgccaccctcgacatcaccggcctccagaccggcgacgaggccgactactactgcggcacctgggacgcctccctctccgccggcggcgtcttcggcaccggcaccaaggtcaccgtcctc

SEQ ID NO: 17899 - RNA, 333 nt, synthetic construct
  misc_feature 1..333: note = derived and/or modified sequence opt2 from anti-HIV_048-191786_VR-Chain
  source 1..333: mol_type = other RNA
cagtccgtcctcacccagcccccctccgtctccgccgcccccggccagaacgtcaacatctcctgctccggctcctcctccaacatcgagaacaacttcgtctcctggtaccagaagctccccggcaccgcccccaagctcctcatctacgacaacaacaagcgcccctccggcatccgcgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17900 - RNA, 333 nt, synthetic construct
  misc_feature 1..333: note = derived and/or modified sequence opt2 from anti-HIV_048-188746_VR-Chain
  source 1..333: mol_type = other RNA
cagtccgtcctcacccagcccccctccgcctccggcacccccggccagaaggtcaccatctcctgctccggctccaactccaacatcggctccaacttcgtctcctggtaccagctcctccccggcaccacccccaagctcctcatctaccgcaacaaccagcgcccctccggcgtccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17901 - RNA, 333 nt, synthetic construct
  misc_feature 1..333: note = derived and/or modified sequence opt2 from anti-HIV_048-185937_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatcccctaccccatctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17902 - RNA, 333 nt, synthetic construct
  misc_feature 1..333: note = derived and/or modified sequence opt2 from anti-HIV_048-184849_VR-Chain
  source 1..333: mol_type = other RNA
cagtccgtcctcacccaggccccctccgcctccggcacccccggccagaccgtcaccatctcctgctccggctcctcctccaacatcggcaccaagtacgtctactggtaccagcagctccccggcaccgcccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctcccccggcggcgtcttcggcaccggcaccaaggtcaccgtcctc

SEQ ID NO: 17903 - RNA, 333 nt, synthetic construct
  misc_feature 1..333: note = derived and/or modified sequence opt2 from anti-HIV_048-183089_VR-Chain
  source 1..333: mol_type = other RNA
cagtccgtcctcacccagcccccctccgcctccggcacccccggccagcgcgtcaccatctcctgctccggctcctcctccaacatcggctcctcctacgtctactggtaccagctcctccccggcaccccccccaagctcctcatcttcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17904 - RNA, 333 nt, synthetic construct
  misc_feature 1..333: note = derived and/or modified sequence opt2 from anti-HIV_048-181509_VR-Chain
  source 1..333: mol_type = other RNA
cagtccgtcctcacccagcccccctccgtctccggcgcccccggccagcgcgtcaccatctcctgcaccggctcctcctccaacatcggcggctacgacgtccactggtaccaccagctccccggcgccgcccccaagctcctcatctacaagaacgacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17905 - RNA, 333 nt, synthetic construct
  misc_feature 1..333: note = derived and/or modified sequence opt2 from anti-HIV_048-180990_VR-Chain
  source 1..333: mol_type = other RNA
cagtccgtcctcacccagcccccctccgtctccgccgcccccggccagcgcgtcaccatctcctgctccggctccacctccaacatcggcaacaactacgtctcctggtaccagcacttccccggcaaggtccccaaggtcgtcatctccgagaccaccaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17906 - RNA, 333 nt, synthetic construct
  misc_feature 1..333: note = derived and/or modified sequence opt2 from anti-HIV_048-177532_VR-Chain
  source 1..333: mol_type = other RNA
cagtccgccctcacccagcccccctccgcctccggctccctcggccagtccgtcaccatctcctgcaccggcacctcctccgacgtcggcaacaacttcgtctcctggtaccagaagaagcccggcaaggcccccaagctcatcgtctacgaggtcaacaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 17907 - RNA, 324 nt, synthetic construct
  misc_feature 1..324: note = derived and/or modified sequence opt2 from anti-HIV_048-177426_VR-Chain
  source 1..324: mol_type = other RNA
ctcacccagccccactccgtctccgagtcccccggcaagaccgtcaccatctcctgcaccggcacctcctccgacgtcggctacaactacgtctcctggtaccagcaccaccccggcaaggcccccaagctcctcatctacgaggtcaccaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17908 - RNA, 333 nt, synthetic construct
  misc_feature 1..333: note = derived and/or modified sequence opt2 from anti-HIV_048-177389_VR-Chain
  source 1..333: mol_type = other RNA
cagtccgtcctcacccagcccccctccatgtccgccgcccccggcgagcgcgtcaccatctcctgctccggctcctcctccaacatcggcaaccaccacgtctcctggtaccagcagcgccccggcaccgcccccaagctcctcatctacgagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17909 - RNA, 333 nt, synthetic construct
  misc_feature 1..333: note = derived and/or modified sequence opt2 from anti-HIV_048-174266_VR-Chain
  source 1..333: mol_type = other RNA
cagtccgtcctcacccagcccccctccgtctccggcgcccccggccagcgcgtcaccatctcctgctccggctcctcctccaacatcggctcccactacgtctcctggtaccagcaggtccccggcaccgccccccgcctcgtcatctacgacaccatcaagcgccactccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17910 - RNA, 333 nt, synthetic construct
  misc_feature 1..333: note = derived and/or modified sequence opt2 from anti-HIV_048-172847_VR-Chain
  source 1..333: mol_type = other RNA
cagtccgtcctcacccagcccccctccgtctccgccgcccccggccagcgcgtcaccgtctcctgctccggctccacctccaacatcgagtccaactacgtctcctggtaccagcaggtccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17911 - RNA, 333 nt, synthetic construct
  misc_feature 1..333: note = derived and/or modified sequence opt2 from anti-HIV_048-172845_VR-Chain
  source 1..333: mol_type = other RNA
cagtccgccctcacccagcccccctccgcctccggctcccccggccagtccgtcaccatctcctgcaccggcacctcctccgacgtcggctacaactacgtctcctggtaccagcagctccccggcaccgcccccaagctcctcatctaccgcaacaaccagcgcccctccggcgtccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 17912 - RNA, 333 nt, synthetic construct
  misc_feature 1..333: note = derived and/or modified sequence opt2 from anti-HIV_048-172363_VR-Chain
  source 1..333: mol_type = other RNA
cagtccgtcctcacccagcccccctccgtctccgccgcccccggccagaaggtcaccatctcctgctccggctccggctccaacatcggcaacacctacgtctcctggtaccagcagctccccggcaccgcccccaagctcctcatcttcgaggacaacaagcgcccctccggcatccccgaccgcttctccggctccaagtccggcacctccgccaccctcgccatcaccggcctccagaccggcgacgaggccgactactactgcggcacctgggactcctccctctccggcggcggcgtcatcggcaccggcaccaagctcaccgtcctc

SEQ ID NO: 17913 - RNA, 333 nt, synthetic construct
  misc_feature 1..333: note = derived and/or modified sequence opt2 from anti-HIV_048-171609_VR-Chain
  source 1..333: mol_type = other RNA
cagtccgtcctcacccagcccccctccgtctccgccgcccccggccaggaggtcaccatctcctgctccgcctcctcctcctccatcggcaacgacttcgtctcctggtaccagcagctccccggcaccgcccccaagctcctcatctacggcaactccaaccgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 17914 - RNA, 333 nt, synthetic construct
  misc_feature 1..333: note = derived and/or modified sequence opt2 from anti-HIV_048-170705_VR-Chain
  source 1..333: mol_type = other RNA
cagtccgtcctcacccagcccccctccgtctccgccgcccccggccagatggtcaccatctcctgctccggctccacctccaacatcggcatcaactacgtctcctggtaccagcacgtccccggcaccgcccccaagctcctcatctacgagaacgtcgagcgccgctccggcatccccgaccgcttctccgcctccaagtccgccacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17915 - RNA, 333 nt, synthetic construct
  misc_feature 1..333: note = derived and/or modified sequence opt2 from anti-HIV_048-168381_VR-Chain
  source 1..333: mol_type = other RNA
cagtccgccctcacccagcccgcctccgtctccggctcccccggccagtccatcaccatctcctgcaccggcacctcctccaacatcggctccaactacgtctcctggtaccagcagctccccggcaccgcccccaagctcctcatctacgagaacaaccagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17916 - RNA, 333 nt, synthetic construct
  misc_feature 1..333: note = derived and/or modified sequence opt2 from anti-HIV_048-166619_VR-Chain
  source 1..333: mol_type = other RNA
cagtccgtcctcacccagcccccctccgtctccggcgcccccggccagcgcgtcaccatctcctgcaccggctcctcctccaacatcggcggctaccacacccactggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17917 - RNA, 333 nt, synthetic construct
  misc_feature 1..333: note = derived and/or modified sequence opt2 from anti-HIV_048-162036_VR-Chain
  source 1..333: mol_type = other RNA
cagtccgtcctcgcccagcccccctccgtctccggcgcccccggccagaccgtcaccatctcctgcaccggctcctcctccaacatcggcggctacgacgtccactggtaccagcagctccccggcaccgcccccaagctcctcatctacaaggacgacaagcgcccctccggcatccccgaccgcttctccggctccaagtccggcacctccgccaccctcggcatcaccggcctccagaccggcgacgaggccgactactactgcggcacctgggacacctccctcaaccgcggcggcgtcttcggcaccggcaccaaggtcaccgtcctc

SEQ ID NO: 17918 - RNA, 333 nt, synthetic construct
  misc_feature 1..333: note = derived and/or modified sequence opt2 from anti-HIV_048-160042_VR-Chain
  source 1..333: mol_type = other RNA
cagtccgtcctcacccagcccccctccgtctccgccgcccccggccagaaggtcaccatctcctgctccggctcctcctccaacatcggcatcaactacatctcctggtaccagcagctccccggcaccgcccccaagatcctcatctacgacaacgacaagcgccccctcggcatccccgaccgcttctccggctccaagtccggcacctccgccaccctcggcatcaccggcctccagaccggcgacgaggccgactactactgcggcacctgggacgcctccctctccgccggcggcgtcttcggcaccggcaccaaggtcaccgtcctc

SEQ ID NO: 17919 - RNA, 333 nt, synthetic construct
  misc_feature 1..333: note = derived and/or modified sequence opt2 from anti-HIV_048-159676_VR-Chain
  source 1..333: mol_type = other RNA
cagtccgtcctcacccagcccccctccgtctccgcctcccccggccagaaggtcaccatctcctgctccggctcctcctccgacatcggctccaactacgtctcctggtacgtccagctccccggcaccgcccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17920 - RNA, 333 nt, synthetic construct
  misc_feature 1..333: note = derived and/or modified sequence opt2 from anti-HIV_048-159500_VR-Chain
  source 1..333: mol_type = other RNA
cagtccgtcctcacccagcccccctccgtctccgccgcccccggccagaacgtcaccatctcctgctccggctcctggtccaacatcggcgccaactacgtctcctggtaccagcagctccccggcaccgcccccaagctcctcatctacgagaacaacaagcgcccctccggcatccccgaccgcttctccggctccaagtccggcacctccgccaccctcggcttcaccggcctccagaccggcgacgaggccgactactactgcggcacctgggacacctccctctccgccggcggcgtcttcggcaccggcaccaaggtcaccgtcctc

SEQ ID NO: 17921 - RNA, 333 nt, synthetic construct
  misc_feature 1..333: note = derived and/or modified sequence opt2 from anti-HIV_048-159421_VR-Chain
  source 1..333: mol_type = other RNA
cagtccctcctcacccaggccccctccgtctccgccgcccccggccagaccgtcaccatctcctgctccggctccaacgccgacatcggcaagaacttcgtctcctggtaccagcagtcccccggcgccgcccccaagctcctcatctacgagaacgaccgccgcccctccggcatccccgaccgcttctccggctccaagtccggcacctccgccaccctcggcatcaccggcctccagaccggcgacgaggccgagtactactgcgccacctgggacgcctccctctccggcggcggcgtcttcggcaccggcaccaaggtcaccgtcctc

SEQ ID NO: 17922 - RNA, 333 nt, synthetic construct
  misc_feature 1..333: note = derived and/or modified sequence opt2 from anti-HIV_048-159333_VR-Chain
  source 1..333: mol_type = other RNA
cagtccgtcctcacccagcccccctccgcctccggcacccccggccagcgcgtcaccatctcctgctccggctccaactccaacatcggctccgactccgtctactggtaccagcagctccccggccgctcccccaagctcctcatctaccgcaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17923 - RNA, 333 nt, synthetic construct
  misc_feature 1..333: note = derived and/or modified sequence opt2 from anti-HIV_048-158932_VR-Chain
  source 1..333: mol_type = other RNA
cagtccgtcctcacccagcccgcctccgtctccggctcccccggccagtccatcaccatctcctgctccggctcctcctccaacatcggcgacatcttcgtctcctggtaccagcaggtccccggcgccgcccccaagctcctcatctacgacaacgacaagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 17924 - RNA, 333 nt, synthetic construct
  misc_feature 1..333: note = derived and/or modified sequence opt2 from anti-HIV_048-155811_VR-Chain
  source 1..333: mol_type = other RNA
cagtccgccctcacccagcccgcctccgtctccggctcccccggccagtccatcaccatctcctgcaccggcacctcctccgacgtcggctacgactacgtctcctggtaccagctcctccccggcaccccccccaagctcctcatcttcaagaacaacgagcgcccctccggcatccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 17925 - RNA, 333 nt, synthetic construct
  misc_feature 1..333: note = derived and/or modified sequence opt2 from anti-HIV_048-155464_VR-Chain
  source 1..333: mol_type = other RNA
cagtccgccctcacccagcccgcctccgtctccggctcccccggccagtccatcaccatctcctgcaccggcgccaccggcgactccggccacacctacgtctcctggtaccagcagctccccggcaccgcccccaagctcctcatctactccaacaacgagcgcccctccggcgtccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17926 - RNA, 333 nt, synthetic construct
  misc_feature 1..333: note = derived and/or modified sequence opt2 from anti-HIV_048-155392_VR-Chain
  source 1..333: mol_type = other RNA
cagtccgtcctcacccagcccccctccgtctccgccgcccccggccagatggtcaccatctcctgctccggctcctcctccaacatcggcgacaactacgtctcctggtaccagcagctccccggccgcggccccaagctcctcgtctacgacacctacaagcgctacctcgagacccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17927 - RNA, 333 nt, synthetic construct
  misc_feature 1..333: note = derived and/or modified sequence opt2 from anti-HIV_048-155389_VR-Chain
  source 1..333: mol_type = other RNA
cagtccgtcctcacccagcccccctccgtctccgccgcccccggccagaaggtcaccatctcctgctccggcatctcctccaacatcggcaacaaccccgtctcctggtaccagcagttccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 17928 - RNA, 333 nt, synthetic construct
  misc_feature 1..333: note = derived and/or modified sequence opt2 from anti-HIV_048-154449_VR-Chain
  source 1..333: mol_type = other RNA
cagtccgtcctcaagcagcccccctccgtctccggcgcccccggcctccgcgtcaccatctcctgcaccggcggctcctccaacatcggcggcttcgacgtccactggtaccagcacttccccggcaccgcccccaagctcctcatctacgacaacgaccagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17929 - RNA, 333 nt, synthetic construct
  misc_feature 1..333: note = derived and/or modified sequence opt2 from anti-HIV_048-153379_VR-Chain
  source 1..333: mol_type = other RNA
cagtccgtcctcacccagcccccctccgtctccgccacccccggccagaaggtcaccatctcctgctccggctcccgctccaacatcggctcccactacgtctcctggtaccagcagttccccgagtccgcccccaagctcctcatctacaagaacgacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17930 - RNA, 333 nt, synthetic construct
  misc_feature 1..333: note = derived and/or modified sequence opt2 from anti-HIV_048-153171_VR-Chain
  source 1..333: mol_type = other RNA
cagtccgtcctcacccagcccccctccgtctccgccgcccccggccagaaggtcaccatctcctgctccggctccacctccaacatcgaggacatctacgtctcctggtaccagcacctccccggcaccgcccccaagctcctcatctacgacaacaacaagcgcccctccggcatccccgaccgcttctccggctccaagtccggcacctccgccaccctcgccatcaccggcctccagaccggcgacgaggccgactactactgcggcacctgggacacctccctctccgccggcggcgtcttcggcaccggcaccaaggtcaccgtcctc

SEQ ID NO: 17931 - RNA, 333 nt, synthetic construct
  misc_feature 1..333: note = derived and/or modified sequence opt2 from anti-HIV_048-152324_VR-Chain
  source 1..333: mol_type = other RNA
cagtccatggtcacccagtccccctccgtctccgccgcccccggccagaaggtcaccatctcctgctccggcacctcctccaacatcggccagaactacgtctcctggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17932 - RNA, 333 nt, synthetic construct
  misc_feature 1..333: note = derived and/or modified sequence opt2 from anti-HIV_048-146102_VR-Chain
  source 1..333: mol_type = other RNA
cagtccgtcctcacccagcccccctccgtctccgccgcccccggccagaaggtcaccatctcctgctccggctcctcctccaccatcggcaacaactacatctcctggtaccagctcctccccggcaccccccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17933 - RNA, 333 nt, synthetic construct
  misc_feature 1..333: note = derived and/or modified sequence opt2 from anti-HIV_048-145984_VR-Chain
  source 1..333: mol_type = other RNA
cagtccgtcctcacccagcccctctccgtctccggcgcccccggccagcgcgtcaccatctcctgcaccggctcctcctccaacatcggctccaacttcgtctcctggtaccaggtcctccccggcaccacccccaagctcctcatcttcaagaacaacgagcgcccctccggcatccccgaccgcttctccggctccaagtccggcacctccgccaccctcggcatcaccggcctccagaccggcgacgaggccgactactactgcggcgcctgggacacctccctctccgccggcggcgtcttcggcaccggcaccaaggtcaccgtcctc

SEQ ID NO: 17934 - RNA, 333 nt, synthetic construct
  misc_feature 1..333: note = derived and/or modified sequence opt2 from anti-HIV_048-145371_VR-Chain
  source 1..333: mol_type = other RNA
cagtccgtcctcacccagcccccctccgtctccgccgcctccggccagaaggtctccatcccctgctccggcggcacctccaacatcggcgacaactacgtctcctggttccagcagttccccggctccgcccccaagatcctcatctacgactccgacaagcgcccctcccgcatctccgaccgcttctccgcctccaagtccggcacctccgccaccctcgacatcacccgcctccagaccggcgacgaggccgactactactgcggcacctgggacacctccctctccgccggcggcgtcttcggcaccggcaccaaggtcaccgtcctc

SEQ ID NO: 17935 - RNA, 333 nt, synthetic construct
  misc_feature 1..333: note = derived and/or modified sequence opt2 from anti-HIV_048-144907_VR-Chain
  source 1..333: mol_type = other RNA
cagtccgccctcacccagcccgcctccgtctccggctcccccggccagtccatcaccatctcctgcaccggcacccgccgcgacgtcggcttcaactacgtctcctggtaccagcagcaccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17936 - RNA, 333 nt, synthetic construct
  misc_feature 1..333: note = derived and/or modified sequence opt2 from anti-HIV_048-142298_VR-Chain
  source 1..333: mol_type = other RNA
cagtccgtcctcacccagcccccctccgcctccggcacccccggccagcgcgtcaccatctcctgctccggctcctcctccaccatcggcaacaactacatctcctggtaccagctcctccccggcaccccccccaagctcctcatcttcaagaacaacgagcgcccctccggcatccccgaccgcttctccgcctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17937 - RNA, 333 nt, synthetic construct
  misc_feature 1..333: note = derived and/or modified sequence opt2 from anti-HIV_048-142277_VR-Chain
  source 1..333: mol_type = other RNA
cagtccgtcctcacccagcccccctccgtctccggcgcccccggccagcgcatcaccatctcctgcaccggctcctcctccaacatcggcgcctacgacgtccagtggtaccagcacctccccggcaccgcccccaagctcctcatctacaagaacaccgagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 17938 - RNA, 333 nt, synthetic construct
  misc_feature 1..333: note = derived and/or modified sequence opt2 from anti-HIV_048-141934_VR-Chain
  source 1..333: mol_type = other RNA
cagtccgtcctcacccagcccccctccgtctccggcgcccccggccagcgcgtcaccatctcctgcaccggcaactcctccaacatcggcgcctacgacgtccactggtaccagcagctccccggcaccgcccccaagctcatgatctacgaggtctccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17939 - RNA, 333 nt, synthetic construct
  misc_feature 1..333: note = derived and/or modified sequence opt2 from anti-HIV_048-141207_VR-Chain
  source 1..333: mol_type = other RNA
cagtccgtcctcacccagcccccctccgtctccgccgcccccggccagaaggtcaccatcgcctgctccggctcctcctccaacatcggcaacaactacgtctcctggtaccagcagctccccggcaccgcccccaagctcctcatctacgccaacaaccgccgcccctccggcatccccgaccgcttctccgcctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17940 - RNA, 333 nt, synthetic construct
  misc_feature 1..333: note = derived and/or modified sequence opt2 from anti-HIV_048-140796_VR-Chain
  source 1..333: mol_type = other RNA
cagtccgtcctcacccagcccccctccgtctccgccacccccggccagaaggtcaccatctcctgctccggcacccgctccaacatcggcaacaactacgtctcctggtaccgccagttccccggcaccgcccccaagctcctcatctacgaggacaacaagcgcccctccggcatccccgcccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17941 - RNA, 333 nt, synthetic construct
  misc_feature 1..333: note = derived and/or modified sequence opt2 from anti-HIV_048-139893_VR-Chain
  source 1..333: mol_type = other RNA
cagtccgtcctcacccagcccccctccgtctccgccacccccggccagaaggtcaccttctcctgctccggctcctcctccaccatcggcaagaactacgtctcctggtaccaggtcctccccggcaccgcccccaagctcctcatctacaagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 17942 - RNA, 333 nt, synthetic construct
  misc_feature 1..333: note = derived and/or modified sequence opt2 from anti-HIV_048-138820_VR-Chain
  source 1..333: mol_type = other RNA
cagtccgtcctcacccagcccccctccgtctccggcgcccccggccagaaggtcaccatctcctgctccggctccggctccaacatcggcaacacctacgtctcctggtaccagcacctccccggcaccgcccccaagctcctcatctacgagaacaacaagcgcccctccggcatccccgaccgcttctccggctccaagtccgccacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17943 - RNA, 333 nt, synthetic construct
  misc_feature 1..333: note = derived and/or modified sequence opt2 from anti-HIV_048-135858_VR-Chain
  source 1..333: mol_type = other RNA
cagtccgtcctcacccagcccccctccgcctccggcacccccggccagcgcgtcaccatctcctgctccggctcctcctccaacatcggctcctcctacgtctactggtaccagcagttccccggccgctccccccgcctcctcatctaccgcaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17944 - RNA, 333 nt, synthetic construct
  misc_feature 1..333: note = derived and/or modified sequence opt2 from anti-HIV_048-134968_VR-Chain
  source 1..333: mol_type = other RNA
cagtccgtcctcacccagcccccctccgtctccgccgcccccggccagaaggtcaccatcttctgctccggctcctcctccaacatcggcaagaactacgtctcctggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17945 - RNA, 333 nt, synthetic construct
  misc_feature 1..333: note = derived and/or modified sequence opt2 from anti-HIV_048-134312_VR-Chain
  source 1..333: mol_type = other RNA
cagtccgtcctcacccagcccccctccgcctccggcacccccggccagcgcgtcaccatctcctgctccggctcctcctccaacatcggcaacaactacgtctcctggtaccgcctcctccccggcaccgcccccaagctcctcatctacaagaacgacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17946 - RNA, 330 nt, synthetic construct
  misc_feature 1..330: note = derived and/or modified sequence opt2 from anti-HIV_048-132253_VR-Chain
  source 1..330: mol_type = other RNA
tccgccctcacccagcccgcctccgtctccggctcccccggccagtccatcgccatctcctgcaccggcacctcctccgacgtcggctacgacctcgtctcctggtaccagcagcaccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17947 - RNA, 333 nt, synthetic construct
  misc_feature 1..333: note = derived and/or modified sequence opt2 from anti-HIV_048-130710_VR-Chain
  source 1..333: mol_type = other RNA
cagtccgtcctcacccagcccccctccgtcgccggcgcccccggccagcgcgtcaccatctcctgcaccggcaacacctccaacatcggcggctacgacgtccactggtaccagcagctccccggcaccccccccaagctcctcatcttcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17948 - RNA, 333 nt, synthetic construct
  misc_feature 1..333: note = derived and/or modified sequence opt2 from anti-HIV_048-128564_VR-Chain
  source 1..333: mol_type = other RNA
cagtccgtcctcacccagcccccctccgcctccggcacccccggccagcgcgtcaccatctcctgctccggctcctcctccaacatcggctccaacaccgtcaactggtaccagcagctccccggcaccgcccccaagctcctcatctacaagaacaccgagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 17949 - RNA, 333 nt, synthetic construct
  misc_feature 1..333: note = derived and/or modified sequence opt2 from anti-HIV_048-126702_VR-Chain
  source 1..333: mol_type = other RNA
cagtccgtcctcacccagcccccctccgcctccgccgcccccggccagcgcgtcaccatctcctgctccggctccaactccaacatcggcaacaactacgtctcctggtaccagcagctccccggcaccgcccccaagctcctcatctacgacaactccaagcgcccctccggcatccccgaccgcttctccgcctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17950 - RNA, 333 nt, synthetic construct
  misc_feature 1..333: note = derived and/or modified sequence opt2 from anti-HIV_048-124521_VR-Chain
  source 1..333: mol_type = other RNA
cagtccgtcctcacccagcccccctccgtctccggcgcccccggccagcgcgtcaccatctcctgcaccggctcctcctccaccttcggcggctacgacgtctactggtaccagcagatccccggcaccgcccccaagctcctcatctacgagaacaacaagcgcccctccggcatccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 17951 - RNA, 333 nt, synthetic construct
  misc_feature 1..333: note = derived and/or modified sequence opt2 from anti-HIV_048-122740_VR-Chain
  source 1..333: mol_type = other RNA
cagtccgtcctcacccagcccccctccatgtccgccgcccccggccagtccgtcaccatctcctgctccggctccaccttcaacatcgagaagcaccaggtcacctggctccgccacctccccggcaccgcccccacctccgtcatcatcatgaactcccagcgcccctccggcacccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 17952 - RNA, 327 nt, synthetic construct
  misc_feature 1..327: note = derived and/or modified sequence opt2 from anti-HIV_048-119536_VR-Chain
  source 1..327: mol_type = other RNA
gagctcacccagtccccctccgtctccgccgcccccggcgagaaggtcaccatctcctgctccggcaccaactccaacatcggctactactacgtctcctggtaccagcagttccccggcaccgcccccaaggtcgtcatctacgagaacaccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17953 - RNA, 333 nt, synthetic construct
  misc_feature 1..333: note = derived and/or modified sequence opt2 from anti-HIV_048-116929_VR-Chain
  source 1..333: mol_type = other RNA
cagtccgtcctcacccagcccccctccgtctccggcgcccccggccagcgcgtcaccatctcctgcaccggctcctcctccaacatcggcgactacgacgtccactggtaccagcagctccccggcaccgcccccaagctcctcatctaccgcaacaaccagcgcccctccggcgtccccgaccgcttctccggctccaagtccggcacctccgccaccctcggcatcaccggcctccagaccggcgacgaggccgactactactgcggcacctgggacgcctccctctccgccggcggcgtcttcggcaccggcaccaaggtcaccgtcctc

SEQ ID NO: 17954 - RNA, 333 nt, synthetic construct
  misc_feature 1..333: note = derived and/or modified sequence opt2 from anti-HIV_048-116577_VR-Chain
  source 1..333: mol_type = other RNA
cagtccgtcctcacccagcccccctccgcctccggcacccccggccagcgcgtcaccatctcctgctccggctcctcctccaacatcggctccaactacgtctcctggtaccaggtcctccccggcaccgcccccaagctcctcatctacaagaacaacaagcgcccctccggcatccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 17955 - RNA, 333 nt, synthetic construct
  misc_feature 1..333: note = derived and/or modified sequence opt2 from anti-HIV_048-116046_VR-Chain
  source 1..333: mol_type = other RNA
cagtccgtcctcacccagcccccctccgtctccggcgcccccggccagcgcgtcaccatctcctgcaccggctcctcctccaacatcggcggctacgacgtccactggtaccagcagttccccggcaccgcccccaagctcctcatctacgacaacgacaagcgcccctccggcatccccgaccgcttctccggctccaagtccggcacctccgccaccctcggcatcaccggcctccagaccggcgacgaggccaactactactgcggcgcctgggacacctccctctccgccggcggcgtcttcggcaccggcaccaaggtcaccgtcctc

SEQ ID NO: 17956 - RNA, 333 nt, synthetic construct
  misc_feature 1..333: note = derived and/or modified sequence opt2 from anti-HIV_048-115875_VR-Chain
  source 1..333: mol_type = other RNA
cagtccgtcctcacccagcccccctccgtctccgccgcccccggccagcgcgtcaccgtctcctgctccggctcctcctccaacatcggcaacaacttcgtctcctggtaccagcacctccccggcaccgcccccaagctcctcatctacgacaactccaaccgcccctccggcatccccgaccgcttctccggctccaagtccggcacctccgccaccctcggcatcaccggcctccacaccggcgacgaggccgactactactgcggcacctgggacacctccctctccgccggcggcgtcttcggctccggcaccaaggtcaccgtcctc

SEQ ID NO: 17957 - RNA, 333 nt, synthetic construct
  misc_feature 1..333: note = derived and/or modified sequence opt2 from anti-HIV_048-115599_VR-Chain
  source 1..333: mol_type = other RNA
cagtccgtcctcacccagcccccctccgtctccgccgcccccggccagatggtcaccatctcctgctccggctcctcctccaacatcggctcccactccgtctcctggtaccagcacttccccggcaccgcccccaagctcgtcatcgaggagaacgaccagcgcccctccggcatccccgaccgcttctccggctccaagtccggcacctccgccaccctcggcatcaccggcctccagaccggcgacgagggcgactactactgcggcacctgggacacctccctctccggcggcggcgtcttcggcaccggcaccaaggtcaccgtcctc

SEQ ID NO: 17958 - RNA, 333 nt, synthetic construct
  misc_feature 1..333: note = derived and/or modified sequence opt2 from anti-HIV_048-113988_VR-Chain
  source 1..333: mol_type = other RNA
cagtccgtcctcacccagcccccctccgtctccgccgcccccggccagatggtcaccatctcctgctccggctcctcccacaacatcggcgagaactacgtctcctggtaccagcacctccccggcaccgcccccaagctcctcatcttcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17959 - RNA, 333 nt, synthetic construct
  misc_feature 1..333: note = derived and/or modified sequence opt2 from anti-HIV_048-112989_VR-Chain
  source 1..333: mol_type = other RNA
cagtccgtcctcacccagcccccctccgcctccggcacccccggccagcgcgtcaccctctcctgctccggcggctcctccaacatcggcaacgacaacgtctactggtaccagcagcgccccggcaccacccccaagctcctcatctacaacgacaaccgccgcccctccggcacccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 17960 - RNA, 333 nt, synthetic construct
  misc_feature 1..333: note = derived and/or modified sequence opt2 from anti-HIV_048-112435_VR-Chain
  source 1..333: mol_type = other RNA
cagtccgtcctcacccagcccccctccgtctccgccgcccccggccagaaggtctccatctcctgctccggctcctcctccaacatcggcaagaactacgtctcctggtaccagcagctccccggcaccgcccccaagctcctcatcttcaagaacaacgagcgcccctccggcatccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 17961 - RNA, 333 nt, synthetic construct
  misc_feature 1..333: note = derived and/or modified sequence opt2 from anti-HIV_048-111339_VR-Chain
  source 1..333: mol_type = other RNA
cagtccgtcctcacccagcccccctccgtctccgccgcccccggccagaaggtcaccatctcctgcaccggctcctcctccaacatcggcggctacgccgtccactggtaccagcaggtccccgccaccgcccccaagctcctcatctacgagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17962 - RNA, 333 nt, synthetic construct
  misc_feature 1..333: note = derived and/or modified sequence opt2 from anti-HIV_048-111055_VR-Chain
  source 1..333: mol_type = other RNA
cagtccgccctcacccagcccgcctccgtctccggctcccccggccagtccatcaccatctcctgcaccggcacccgctccgacgtcggctacaactacgtctcctggtaccagcagcaccccggcaaggcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17963 - RNA, 333 nt, synthetic construct
  misc_feature 1..333: note = derived and/or modified sequence opt2 from anti-HIV_048-111027_VR-Chain
  source 1..333: mol_type = other RNA
cagtccgtcctcacccagcccccctccgtctccgccgcccccggccagaaggtcaccatctcctgctccggctccaactccaacctcggcaacaactacgtctcctggtaccagcacctccccggcaccgccccccgcctcctcatctacgaggacaagaagcgcccctccggcatccccgaccgcttctccggctccaagtccggcgcctccgccaccctcgacatcaccggcctccagaccggcgacgaggccgactactactgcggcatctgggacacctccctctccgccggcggcgtcttcggcaccggcaccaaggtcaccgtcctc

SEQ ID NO: 17964 - RNA, 333 nt, synthetic construct
  misc_feature 1..333: note = derived and/or modified sequence opt2 from anti-HIV_048-109721_VR-Chain
  source 1..333: mol_type = other RNA
cagtccgtcctcacccagcccccctccgtctccgccgcccccggccagaaggtcaccatctcctgctccggctcctcctccgacatcggctccaacttcgtctcctggtaccagcacctccccggcaccgccccccgcctcctcatctacgagaacaaccgccgcccctccggcatccccgaccgcttctccggctccaagtccggcacctccgccaccctcgccatcaccggcctccagaccggcgacgaggccgactactactgcggcacctgggacacctccctcaaccgcggcggcgtcttcggcaccggcaccaaggtcaccgtcctc

SEQ ID NO: 17965 - RNA, 333 nt, synthetic construct
  misc_feature 1..333: note = derived and/or modified sequence opt2 from anti-HIV_048-109666_VR-Chain
  source 1..333: mol_type = other RNA
cagtccgtcctcacccagcccccctccatgtccgccgcccccggcgagcgcgtcaccatctcctgctccggctcctcctccaacatcggcaaccaccacgtctcctggtaccagcagcgccccggcaccgcccccaagctcctcatctacgagaacaacgagcgcccctccggcatccccgaccgcttctccggctccaagtccggctcctccgccaccctcgccatcaccggcctccagaccggcgacgaggccgactactactgcggcacctgggacggccgcctcaacatcggcggcgtcatcggcaccggcaccaaggtcaccgtcctc

SEQ ID NO: 17966 - RNA, 333 nt, synthetic construct
  misc_feature 1..333: note = derived and/or modified sequence opt2 from anti-HIV_048-109196_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgagaccaacaagcgcccctccggcatccccgaccgcttctccggctccaagtccggcacctccgccaccctcgccatcaccggcctccagaccggcgacgaggccgactactactgcggcacctgggacacctccctctccggcggcggcgtcttcggcaccggcaccaaggtcaccgtcctc

SEQ ID NO: 17967 - RNA, 333 nt, synthetic construct
  misc_feature 1..333: note = derived and/or modified sequence opt2 from anti-HIV_048-109051_VR-Chain
  source 1..333: mol_type = other RNA
cagtccgtcctcacccagcccccctccgtctccgccgcccccggccagaaggtcaccatctcctgctccggcaacaactccaacatggtcaacaactacatctcctggtaccagctcctccccggcaccccccccaagctcctcatcttcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17968 - RNA, 333 nt, synthetic construct
  misc_feature 1..333: note = derived and/or modified sequence opt2 from anti-HIV_048-108570_VR-Chain
  source 1..333: mol_type = other RNA
cagtccgccctcacccagcccccctccgtctccgccgcccccggccagaaggtcaccatctcctgctccggcaagtcctccaacatcggcaccaacttcgtctcctggtaccagcagttccccgaggccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggacggctccctctccaccggcggcgtcatcggcaccggcaccaaggtcaccgtcctc

SEQ ID NO: 17969 - RNA, 327 nt, synthetic construct
  misc_feature 1..327: note = derived and/or modified sequence opt2 from anti-HIV_048-108033_VR-Chain
  source 1..327: mol_type = other RNA
gagctcacccagtccccctccgtctccgccgcccccggccagcgcgtcaccatctcctgctccggcaactcctccaacatcggcaacaactacgtctcctggtaccagctcctccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 17970 - RNA, 333 nt, synthetic construct
  misc_feature 1..333: note = derived and/or modified sequence opt2 from anti-HIV_048-107279_VR-Chain
  source 1..333: mol_type = other RNA
cagtccgtcctcacccagcccccctccgtctccgccgcccccggccagaaggtcatcatctcctgctccggctcctcctccaacatcggcaagaactacgtctcctggtaccagcacctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacgcctccctctccgccggcggcgtcctcggcaccggcaccaaggtcaccgtcctc

SEQ ID NO: 17971 - RNA, 333 nt, synthetic construct
  misc_feature 1..333: note = derived and/or modified sequence opt2 from anti-HIV_048-106271_VR-Chain
  source 1..333: mol_type = other RNA
cagtccgtcctcacccagcccccctccgtctccgccgcccccggccagaaggtcaccatctcctgctccggctcccgctccaacatcggctccaactacatctcctggtaccagcagctccccggcaccgcccccaagctcctcatctacaagaacgacaagcgcccctccggcatccccgaccgcttctccggctccaagtccggcacctccgccatcctcggcatcaccggcctccagaccggcgacgaggccgactactactgcggcgcctgggacacctccctctccgccggcggcgtcttcggcaccggcaccaaggtcaccgtcctc

SEQ ID NO: 17972 - RNA, 333 nt, synthetic construct
  misc_feature 1..333: note = derived and/or modified sequence opt2 from anti-HIV_048-106054_VR-Chain
  source 1..333: mol_type = other RNA
cagtccgtcctcacccagcccccctccgtctccgccgcccccggccagcaggtcaccatctcctgctccggctccacctccaacatcggcaacaactacgtctcctggtaccagcaggtccccggcaccgcccccaagctcctcatctacgacaacaacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 17973 - RNA, 333 nt, synthetic construct
  misc_feature 1..333: note = derived and/or modified sequence opt2 from anti-HIV_048-104848_VR-Chain
  source 1..333: mol_type = other RNA
cagtccgccctcacccagcccgcctccgtctccggctcccccggccagtccatcaccatctcctgcaccggcacctcctccgacgtcggctacaactacgtctcctggtaccagcagctccccggcaccgcccccaagctcctcatcttcgacaacgacgaccgcccctccgagatccccgaccgcttctccggctccaagtccggcacctccgccaccctcggcatcaccggcctccagcccggcgacgaggccgactactactgcggcacctgggactcctccctctccgccggcggcgtcttcggcaccggcaccaaggtcaccgtcctc

SEQ ID NO: 17974 - RNA, 333 nt, synthetic construct
  misc_feature 1..333: note = derived and/or modified sequence opt2 from anti-HIV_048-104638_VR-Chain
  source 1..333: mol_type = other RNA
cagtccgtcctcacccagcccccctccgcctccggcacccccggccaccgcgtcaccatctcctgctccggcaactcctccaacatcggcggcaaccacgtctactggtaccagcaggtccccggcaccacccccaagctcctcatctaccgcaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17975 - RNA, 333 nt, synthetic construct
  misc_feature 1..333: note = derived and/or modified sequence opt2 from anti-HIV_048-104567_VR-Chain
  source 1..333: mol_type = other RNA
cagtccgtcctcacccagcccccctccgcctccggcacccccggccagcgcgtcaccatctcctgctccggctccaactccaacatcggcaccaacttcgtcaactggtaccagcacgtccccggccgcgcccccaagctcctcatctacaagaacaccgagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 17976 - RNA, 333 nt, synthetic construct
  misc_feature 1..333: note = derived and/or modified sequence opt2 from anti-HIV_048-102804_VR-Chain
  source 1..333: mol_type = other RNA
cagtccgtcctcacccagcccccctccgtctccaccgcccccggccagaaggtcaccatctcctgctccggctcctcctccaacatcggctactcctacgtctcctggttccagcacctccccggcaccgcccccaagctcctcatctacggcaactccaaccgcccctccggcgtccccgaccgcttctccggctccaagtccggcacctccgcctccctcgccatcaccggcctccagaccggcgacgaggccgactactactgcggcacctgggactcctccctctccgccggcggcgtcttcggcaccggcaccaaggtcaccgtcctc

SEQ ID NO: 17977 - RNA, 333 nt, synthetic construct
  misc_feature 1..333: note = derived and/or modified sequence opt2 from anti-HIV_048-101676_VR-Chain
  source 1..333: mol_type = other RNA
cagtccgtcctcacccagcccccctccgtctccggcgcccccggccagtccgtcaccatctcctgcaccggcacctcctccaacatcggcgacttcgacgtccactggtaccagcagctccccggcaccgcccccaagctcctcctctacgagaacaacaagcgcccctccggcatccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 17978 - RNA, 333 nt, synthetic construct
  misc_feature 1..333: note = derived and/or modified sequence opt2 from anti-HIV_048-097603_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcatctacgacaccgtcaagcgcccctccggcatccccgaccgcttctccggctccaagtccggcacctccgccaccctcggcatcaccggcctccagaccggcgacgaggccgactactactgcggcacctgggactcctccctctccggcggcggcgtcttcggcaccggcaccaaggtcaccgtcctc

SEQ ID NO: 17979 - RNA, 333 nt, synthetic construct
  misc_feature 1..333: note = derived and/or modified sequence opt2 from anti-HIV_048-097107_VR-Chain
  source 1..333: mol_type = other RNA
cagtccgtcctcacccagcccccctccgtctccgccgcccccggccagaaggtcaccatctcctgctccggctcctcctccaacatcgagaacaactacgtctcctggtaccgccaggtccccggcaccgcccccaagctcctcatctacaagaacgacaaccgcccctccggcatccccgaccgcttctccggctccaagtccggcacctccgccaccctcggcatcaccggcctccagaccggcgacgaggccgactactactgcggcatctgggacacctccctctccgccggcggcgtcttcggcaccggcaccaaggtcaccgtcctc

SEQ ID NO: 17980 - RNA, 333 nt, synthetic construct
  misc_feature 1..333: note = derived and/or modified sequence opt2 from anti-HIV_048-096871_VR-Chain
  source 1..333: mol_type = other RNA
cagcccgtcctcacccagcccccctccgcctccggcacccccggccagcgcgtcaccatctcctgctccggctcctcctccaacatcggctccaactacgtctactggtaccagcagctccccggcaccacccccaagctcctcatctaccgcaacaaccagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 17981 - RNA, 333 nt, synthetic construct
  misc_feature 1..333: note = derived and/or modified sequence opt2 from anti-HIV_048-096668_VR-Chain
  source 1..333: mol_type = other RNA
cagtccgtcctcacccagcccccctccgtctccgccgcccccggccagaaggtcaccatctcctgctccggctccggctccaacatcggcaacaactacgtctcctggtaccagcagctccccggcaccgcccccaagctcctcatctacaagaacaccgagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 17982 - RNA, 333 nt, synthetic construct
  misc_feature 1..333: note = derived and/or modified sequence opt2 from anti-HIV_048-095236_VR-Chain
  source 1..333: mol_type = other RNA
cagtccgtcctcacccagcccccctccgtctccgccccccccggccagaaggtcaccatctcctgctccggcaccacctccaacatcggctccaactacgtcgcctggtaccagcagctccccggcaccgcccccaagctcgtcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17983 - RNA, 333 nt, synthetic construct
  misc_feature 1..333: note = derived and/or modified sequence opt2 from anti-HIV_048-094155_VR-Chain
  source 1..333: mol_type = other RNA
cagtccgtcctcacccagcccccctccgtctccgccgcccccggccagaaggtcaccgtctcctgctccggctcctcctccgacatcggcgagaactacgtctcctggtaccagcagttccccgagaccgcccccaagctcctcatctacgacaacaacaagcgcccctccggcatccccgaccgcttctccggctccaagtccggcacctccgccaccctcgccatcaccggcctccagaccggcgacgaggccgactactactgcggcacctgggactcctccctctccgccggcggcgtcttcggcaccggcaccaaggtcaccgtcctc

SEQ ID NO: 17984 - RNA, 333 nt, synthetic construct
  misc_feature 1..333: note = derived and/or modified sequence opt2 from anti-HIV_048-093219_VR-Chain
  source 1..333: mol_type = other RNA
cagcccctcctcacccagccccccgccgtctccgccacccccggccagcgcgtcaccatctcctgcaccggctcctcctccaacatcggccgcaccttcgtcaactggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17985 - RNA, 333 nt, synthetic construct
  misc_feature 1..333: note = derived and/or modified sequence opt2 from anti-HIV_048-092976_VR-Chain
  source 1..333: mol_type = other RNA
cagtccgtcctcacccagcccccctccgtctccgccgcctccggccagaaggtcaccatctcctgctccggctcctcctccaacatcggcaacaactacgtctcctggtaccagcacctccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17986 - RNA, 333 nt, synthetic construct
  misc_feature 1..333: note = derived and/or modified sequence opt2 from anti-HIV_048-090866_VR-Chain
  source 1..333: mol_type = other RNA
cagtccgtcctcacccagcccccctccgtctccgccgcccccggccagaaggtcaccatctcctgctccggctcccgctccaacatcggctccaactacatctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggcctactactactgcggcacctgggacacctccctctccgccggcggcgtcttcggctccggcaccaaggtcaccgtcctc

SEQ ID NO: 17987 - RNA, 333 nt, synthetic construct
  misc_feature 1..333: note = derived and/or modified sequence opt2 from anti-HIV_048-090650_VR-Chain
  source 1..333: mol_type = other RNA
cagtccgccctcacccagcccgcctccgtctccggctccctcggccagtccatcaccatctcctgctccggctcctcctccaccatcggcaacaactacgtctcctggtaccaggtcctccccggcgccgcccccaagctcctcatctgcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 17988 - RNA, 333 nt, synthetic construct
  misc_feature 1..333: note = derived and/or modified sequence opt2 from anti-HIV_048-089009_VR-Chain
  source 1..333: mol_type = other RNA
cagtccgtcctcacccagcccccctccgtctccgccgcccccggccagaaggtcaccatctcctgctccggcggctcctccaacatcggcaacaactacgtctcctggtaccagcagctccccgagaccgcccccaagctcatcatctacgacaacaacaagcgcccctccggcatccacgaccgcttctccggctccaagtccggcacctccgccaccctcgacatcaccgccctccagaccggcgacgaggccgactactactgcggcacctgggacacctccctctccgccggcggcgtcttcggcaccggcaccaaggtcaccgtcctc

SEQ ID NO: 17989 - RNA, 333 nt, synthetic construct
  misc_feature 1..333: note = derived and/or modified sequence opt2 from anti-HIV_048-088654_VR-Chain
  source 1..333: mol_type = other RNA
cagtccgccctcacccagccccgctccgtctccgccgcccccggccagaaggtctccatctcctgctccggccgctccaccaacctcggctacaactacgtctcctggtaccagcacctccccggcgccgcccccaaggtcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17990 - RNA, 333 nt, synthetic construct
  misc_feature 1..333: note = derived and/or modified sequence opt2 from anti-HIV_048-086513_VR-Chain
  source 1..333: mol_type = other RNA
cagtccgccctcacccagcccccctccgtctccgccgcccccggccagaaggtcaccatctcctgctccggctccacctccaacatcggcaacaactacgtctcctggtaccagcagctccccggcaccgcccccaagctcctcatctacaagaacgacaaccgcccctccggcatccccgaccgcttctcctcctccaagtccggcacctccgccaccctcggcatcaccggcctccagaccggcgacgaggccgactactactgcggcatctgggacacctccctctccgccggcggcgtcttcggcaccggcaccaaggtcaccgtcctc

SEQ ID NO: 17991 - RNA, 324 nt, synthetic construct
  misc_feature 1..324: note = derived and/or modified sequence opt2 from anti-HIV_048-086024_VR-Chain
  source 1..324: mol_type = other RNA
ctcgcccagcccccctccgtctccggcacccccggccagcgcgtcaccatctcctgctccggctcctcctccaacatcggctccaacgccgtcaactggtaccagcagttccccggcaccgcccccaagctcctcatctacgacaccgacaagcgcccctccggcatccccgaccgcttctccggctccaagtccggcacctccgccatcctcggcatcaccggcctccagaccggcgacgaggccgactactactgcggcgcctgggacacctccctctccgccggcggcgtcttcggcaccggcaccaaggtcaccgtcctc

SEQ ID NO: 17992 - RNA, 333 nt, synthetic construct
  misc_feature 1..333: note = derived and/or modified sequence opt2 from anti-HIV_048-085857_VR-Chain
  source 1..333: mol_type = other RNA
cagtccgccctcacccagccccgctccgtctccggctccctcggccagtccgtcaccatctcctgcaccggcaccacctccgacgtcggcttcgactacgtctcctggtaccaggtcctccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 17993 - RNA, 333 nt, synthetic construct
  misc_feature 1..333: note = derived and/or modified sequence opt2 from anti-HIV_048-084277_VR-Chain
  source 1..333: mol_type = other RNA
cagtccgtcctccgccagcccccctccctctccggcgcccccggccagcgcgtcaccctctcctgcaccggctcctcctccaacatcggcggctacgacgtccactggtaccagcacgtccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17994 - RNA, 333 nt, synthetic construct
  misc_feature 1..333: note = derived and/or modified sequence opt2 from anti-HIV_048-084245_VR-Chain
  source 1..333: mol_type = other RNA
cagtccaccctcacccagcccccctccgtctccgccgcccccggccagaaggtcaccatctcctgctccggctccaactccaacatcggcaagcactacgtctcctggtaccagcagttccccggcgccgtccccaagctcctcatctacgagaacaagaagcgcccctccggcatccccgaccgcttctccggctccaagtccgacacctccgccaccctcgacatcaccggcctccagaccggcgacgaggccgactactactgcggcacctgggacacctccctctccgccggcggcgtcttcggctccggcaccaaggtcaccgtcctc

SEQ ID NO: 17995 - RNA, 333 nt, synthetic construct
  misc_feature 1..333: note = derived and/or modified sequence opt2 from anti-HIV_048-082487_VR-Chain
  source 1..333: mol_type = other RNA
cagtccctcctcacccagcccccctccgtctccgccgcccccggccagaaggtcaccatctcctgctccggctcctcctccaccatcggcaacaactacgtctcctggtaccaggtcctccccggcgccgcccccaagctcctcatctgcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17996 - RNA, 333 nt, synthetic construct
  misc_feature 1..333: note = derived and/or modified sequence opt2 from anti-HIV_048-081787_VR-Chain
  source 1..333: mol_type = other RNA
cagtccgtcctcacccagcccccctccgtctccggcgcccccggccagcgcgtcaccatctcctgcaccggctcctcctccaacatcggctcctacgacgtccactggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 17997 - RNA, 333 nt, synthetic construct
  misc_feature 1..333: note = derived and/or modified sequence opt2 from anti-HIV_048-081062_VR-Chain
  source 1..333: mol_type = other RNA
cagtccgtcctcacccagcccccctccgtctccgccgcccccggccagaaggtcaccatctcctgctccggcacctcctccaacatcggcgccaactacgtctcctggtaccagcaggtccccggcaccgcccccaagctcctcatctacgagaacaacaagcgcccctccggcacccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 17998 - RNA, 333 nt, synthetic construct
  misc_feature 1..333: note = derived and/or modified sequence opt2 from anti-HIV_048-079639_VR-Chain
  source 1..333: mol_type = other RNA
cagtccgtcctcacccagcccccctccgtctccgccgcccccggccagaaggtcaccatctcctgctccggctcctcctccaacatcggcaagaactacgtctcctggtaccagcacctccccggcaccgcccccaagctcctcatctacgagaacaacaagcgcccctccggcatccccgaccgcttctccggctccaagtccggcaccgccgccaccctcggcatcaccggcctccagaccggcgacgaggccggctactactgcggcacctgggacacctccctctccgccggcggcgtcttcggcaccggcaccaaggtcaccgtcctc

SEQ ID NO: 17999 - RNA, 333 nt, synthetic construct
  misc_feature 1..333: note = derived and/or modified sequence opt2 from anti-HIV_048-079126_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcacctccccggcaccccccccaagctcctcatcttcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18000 - RNA, 333 nt, synthetic construct
  misc_feature 1..333: note = derived and/or modified sequence opt2 from anti-HIV_048-073118_VR-Chain
  source 1..333: mol_type = other RNA
cagtccgtcctcacccagcccccctccgtctccgccgccccccgccacaacgtcaccatctcctgctccggcggctcctccaacatcggcaacaacttcgtctcctggtaccagtacctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 18001 - RNA, 333 nt, synthetic construct
  misc_feature 1..333: note = derived and/or modified sequence opt2 from anti-HIV_048-070264_VR-Chain
  source 1..333: mol_type = other RNA
cagtccgtcctcacccagtccccctccgtctccgccgcccccggccagaaggtcaccatctcctgctccggcacctcctccaacatcggcaacacctacgtctcctggtaccagcagctccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18002 - RNA, 333 nt, synthetic construct
  misc_feature 1..333: note = derived and/or modified sequence opt2 from anti-HIV_048-069426_VR-Chain
  source 1..333: mol_type = other RNA
cagtccgtcctcacccagcccccctccgtctccgccgcccccggccagaaggtcaccatctcctgctccggctcctcctccaccatcggcaacaactacgtctcctggtaccagcagctccccggcaccgcccccaagctcctcatctacaagaacaacaagcgcccctccggcgtccccgaccgcttctccggctccaagtccggcacctccgccacccccggcatcaccggcctccagaccggcgacgaggccgactactactgcggcacctgggacacctccctctccgccggcggcgtcttcggcaccggcaccaaggtcaccgtcctc

SEQ ID NO: 18003 - RNA, 333 nt, synthetic construct
  misc_feature 1..333: note = derived and/or modified sequence opt2 from anti-HIV_048-068564_VR-Chain
  source 1..333: mol_type = other RNA
cagtccgccctcacccagccccgctccgtctccggctcccccggccagtccgtcgccatctcctgcaccggcacctcctccgacgtcggctacaactacgtctcctggtaccaggtcctccccggcaccgcccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18004 - RNA, 333 nt, synthetic construct
  misc_feature 1..333: note = derived and/or modified sequence opt2 from anti-HIV_048-068345_VR-Chain
  source 1..333: mol_type = other RNA
cagtccgtcctcacccagaccccctccgtctccgccgcccccggccagcgcgtcaccatctcctgctccggctccacctccaacatcggcaacaactacgtctcctggtaccagcagctccccggcaccgcccccaagctcctcatctacgagaacaacaagcgcccctccggcatccgcgaccgcttctccgcctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18005 - RNA, 333 nt, synthetic construct
  misc_feature 1..333: note = derived and/or modified sequence opt2 from anti-HIV_048-067337_VR-Chain
  source 1..333: mol_type = other RNA
cagtccgtcctcacccagcccccctccgtctccgccgcccccggccagaaggtcaccatctcctgctccggcgcctcctacaacatcggcaagaactccgtctcctggtaccagcagctccccggcaccgcccccaagctcctcatctacaagaacgacaagcgcccctccggcatccccgaccgcttctccggctccaagtccggcgcctccgccaccctcgacatcaccggcctccagaccggcgacgaggccgactactactgcggcatctgggacacctccctctccgccggcggcgtcttcggcaccggcaccaaggtcaccgtcctc

SEQ ID NO: 18006 - RNA, 333 nt, synthetic construct
  misc_feature 1..333: note = derived and/or modified sequence opt2 from anti-HIV_048-067180_VR-Chain
  source 1..333: mol_type = other RNA
cagtccgtcctcacccagcccccctccgtctccgccgcccccggccagaaggtcaccatctcctgctccggctcctcccccaacatcggcaacaactacgtctcctggtaccagcgcctccccggcaccgcccccaagctcctcatctacgagaacgaccagcgcccctccggcatccccgaccgcatctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 18007 - RNA, 333 nt, synthetic construct
  misc_feature 1..333: note = derived and/or modified sequence opt2 from anti-HIV_048-063017_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcaccaccccggcaaggcccccaagctcatgatctacgaggtctccaagcgcccctccggcatccccgaccgcttctccggctccaagtccggcacctccgccaccctcggcatcaccggcctccagaccggcgacgaggccgactactactgcggcacctgggacacctccctcaaccgcggcggcgtcttcggcaccggcaccaaggtcaccgtcctc

SEQ ID NO: 18008 - RNA, 333 nt, synthetic construct
  misc_feature 1..333: note = derived and/or modified sequence opt2 from anti-HIV_048-061885_VR-Chain
  source 1..333: mol_type = other RNA
cagtccgtcctcacccagcccccctccgtctccgccgcccccggccagaaggtcaccatctcctgctccggctcctcctccaacatcggctcccactacatctcctggtaccagcagttccccggcgccgcccccaagctcctcatctacgagaacgacaagcgcccctccggcatccccgaccgcttctccgcctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18009 - RNA, 333 nt, synthetic construct
  misc_feature 1..333: note = derived and/or modified sequence opt2 from anti-HIV_048-061671_VR-Chain
  source 1..333: mol_type = other RNA
cagtccgtcctcacccagcccccctccgcctccggcacccccggccagcgcgtcaccatctcctgctccggctcccgctccaacatcggctccaactacgtctactggtaccagcagttccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 18010 - RNA, 333 nt, synthetic construct
  misc_feature 1..333: note = derived and/or modified sequence opt2 from anti-HIV_048-060700_VR-Chain
  source 1..333: mol_type = other RNA
cagtccgtcctcacccagctcccctccctctccgccgcccccggccagaaggtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgagtactactgcgccacctgggacgcctccctctccggcggcggcgtcttcggcaccggcaccaaggtcaccgtcctc

SEQ ID NO: 18011 - RNA, 333 nt, synthetic construct
  misc_feature 1..333: note = derived and/or modified sequence opt2 from anti-HIV_048-060592_VR-Chain
  source 1..333: mol_type = other RNA
cagtccgtcctcacccagcccccctccgtctccgccgcccccggccagaaggtcaccatctcctgctccggctcctcctccaacatcggcaagaactacgtctcctggtaccagcagttccccggcaccgcccccaagctcctcatctacgagaacaacaagcgcccctccggcatccccgaccgcttctccgcctccaagtccgccacctccgccaccctcgtcatcaccggcctccagaccggcgacgaggccgtctactactgcggcacctgggacacctccctctccgccggcggcgtcttcggctccggcaccaaggtcaccgtcctc

SEQ ID NO: 18012 - RNA, 333 nt, synthetic construct
  misc_feature 1..333: note = derived and/or modified sequence opt2 from anti-HIV_048-060300_VR-Chain
  source 1..333: mol_type = other RNA
cagcccgtcctcacccagcccccctccgcctccggcacccccggccagcgcgtcaccatctcctgctccggctcctcctccaacatcggcaccaacaccgtcaactggtaccagcagttccccggcaccgcccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 18013 - RNA, 333 nt, synthetic construct
  misc_feature 1..333: note = derived and/or modified sequence opt2 from anti-HIV_048-059141_VR-Chain
  source 1..333: mol_type = other RNA
cagcccgtcctcacccagcccccctccgcctccggcacccccggccagcgcgtctccatctcctgctccggcaacttctccaacatcggctccaagtacgtctactggtaccagcagatccccggcaccgcccccaacgtcatcatctaccgcaccaacctccgcccctccggcatccccgaccgcttctccgcctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18014 - RNA, 333 nt, synthetic construct
  misc_feature 1..333: note = derived and/or modified sequence opt2 from anti-HIV_048-057777_VR-Chain
  source 1..333: mol_type = other RNA
cagtccgtcctcacccagcccccctccctctccgccgcccccggccagcgcgtcaccatctcctgctccggctcctcctccaacatcggcaacaactacgtctcctggtaccagcagttccccggcaccgcccccaccctcctcatctacgagaacgacaagcgcccctccggcatccccgaccgcttctccgcctccaagtccggcacctccgccaccctcggcatcaccggcctccaggccggcgacgaggccgactactactgcggcacctgggacacctccctctccgccggcggcgtcttcggcaccggcaccaaggtcaccgtcctc

SEQ ID NO: 18015 - RNA, 333 nt, synthetic construct
  misc_feature 1..333: note = derived and/or modified sequence opt2 from anti-HIV_048-056928_VR-Chain
  source 1..333: mol_type = other RNA
cagtccgtcctcacccagcccccctccgtctccgccgcccccggccagaaggtcaccatctcctgctccggctcctcctccaccatcggcaacaactacgtctcctggtaccagctcctccccggcaccgcccccaagctcctcatctacgacaacgacaaccgcccctccgacatccccgaccgcttctccggctccaagtccggcacctccgccaccctcggcatcaccggcctccagaccggcgacgaggccgactactactgcggcgcctgggacacctccctctccgccggcggcgtcttcggcaccggcaccaaggtcaccgtcctc

SEQ ID NO: 18016 - RNA, 333 nt, synthetic construct
  misc_feature 1..333: note = derived and/or modified sequence opt2 from anti-HIV_048-056131_VR-Chain
  source 1..333: mol_type = other RNA
cagttcgtcctcacccagcccgcctccgtctccggctcccccggccagtccatcaccatctcctgctccggcacctcctccgacgtcggctacaactacgtctcctggtaccagcagctccccggcaccgcccccaagctcctcatctacgagaacaccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 18017 - RNA, 333 nt, synthetic construct
  misc_feature 1..333: note = derived and/or modified sequence opt2 from anti-HIV_048-055864_VR-Chain
  source 1..333: mol_type = other RNA
cagtccgtcctcacccagcccccctccgtctccgtcgcccccggccagaaggtcaccatctactgctccggctcctcctccaacatcggcaagaactccgtctcctggtacgtccaggtccccggcaccgcccccaagttcctcatctacgagaacaaccagcgcccctccggcatctccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 18018 - RNA, 333 nt, synthetic construct
  misc_feature 1..333: note = derived and/or modified sequence opt2 from anti-HIV_048-055094_VR-Chain
  source 1..333: mol_type = other RNA
cagtccgtcctcacccagcccccctccgtctccggcgcccccggccagcgcgtcaccatctcctgctccgcctcctcctcctccatcggcaacgacttcgtctcctggtaccagcagctccccggcaccgcccccaagctcctcatctccgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18019 - RNA, 333 nt, synthetic construct
  misc_feature 1..333: note = derived and/or modified sequence opt2 from anti-HIV_048-054343_VR-Chain
  source 1..333: mol_type = other RNA
cagtccgtcctcacccagcccccctccgtctccggcgcccccggccagcgcgtcaccatctcctgcaccggctcctcctccaacatcggcggctacgacgtcaactggtaccagcagctccccggcaccgcccccaagctcctcatcttcaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18020 - RNA, 333 nt, synthetic construct
  misc_feature 1..333: note = derived and/or modified sequence opt2 from anti-HIV_048-054193_VR-Chain
  source 1..333: mol_type = other RNA
cagtccgtcctcacccagcccccctccgtctccgccgcccccggccagaaggtcaccatctcctgctccggcggctcctccaacatcggcaacaactacgtctcctggtaccaccaggtccccggcaccgcccccaagctcctcatcttcgagaacaacaagcgcccctccggcatccccgaccgcttctccggctccaagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 18021 - RNA, 333 nt, synthetic construct
  misc_feature 1..333: note = derived and/or modified sequence opt2 from anti-HIV_048-052521_VR-Chain
  source 1..333: mol_type = other RNA
cagtccgtcctcacccagcccccctccgtctccgccgcccccggccagaaggtcaccatctcctgctccggctcctcctccaacatcggccgccactccgtctcctggtaccagcagctccccggcaccgcccccaagctcctcatctacgacaccgacaagcgcccctccggcatccccgaccgcttctccggctccaagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 18022 - RNA, 333 nt, synthetic construct
  misc_feature 1..333: note = derived and/or modified sequence opt2 from anti-HIV_048-049037_VR-Chain
  source 1..333: mol_type = other RNA
cagtccgtcctcacccagcccccctccgtctccgccgcccccggccagaaggtcaccatctcctgctccggctcctccttcaacatcggcaacaactacgtctcctggtaccagcacctccccggcaccgcccccaagctcctcatctacgccgccgtcacccgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 18023 - RNA, 333 nt, synthetic construct
  misc_feature 1..333: note = derived and/or modified sequence opt2 from anti-HIV_048-048720_VR-Chain
  source 1..333: mol_type = other RNA
cagtccgtcctcacccagccccccgccgtctccgccgcccccggccagcgcgtcgccatctcctgctccggcacctcctccaacatcggctccaacctcgtctcctggtaccagcagctccccggcaaggccccccgcctcctcatctacgacaactacaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 18024 - RNA, 333 nt, synthetic construct
  misc_feature 1..333: note = derived and/or modified sequence opt2 from anti-HIV_048-048542_VR-Chain
  source 1..333: mol_type = other RNA
cagtccgtcctcacccagcccccctccgtctccgccgcccccggccagaaggtcaccatctcctgctccggctcctcctccaacatcggcaacaacttcgtctcctggtaccagcagctccccggcaccgcccccaagctcctcatctacaacaacgaccgccgcccctccggcgtccccgaccgcttctccgcctccaagttcggcaccgccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18025 - RNA, 333 nt, synthetic construct
  misc_feature 1..333: note = derived and/or modified sequence opt2 from anti-HIV_048-047777_VR-Chain
  source 1..333: mol_type = other RNA
cagtccgtcctcacccagcccccctccgcctccggcacccccggccagcgcgtcaccatctcctgctccggctcctccgccaacatcggcaccaactacgtcttctggtaccagcacctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18026 - RNA, 333 nt, synthetic construct
  misc_feature 1..333: note = derived and/or modified sequence opt2 from anti-HIV_048-046841_VR-Chain
  source 1..333: mol_type = other RNA
cagtccgtcctcacccagcccccctccgtctccgccgccctcggccagaaggtcaccatcacctgctccggcgacaacggcaacatcggctaccactacgtctcctggtaccagcaggtcggccgcgccgcccccaagctcctcatctacgccaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 18027 - RNA, 333 nt, synthetic construct
  misc_feature 1..333: note = derived and/or modified sequence opt2 from anti-HIV_048-046202_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcacctccccggcaccgcccccaagctcctcatctacgacacctacaagcgccactccggcgtccccgaccgcttctccaactccaagtccggcacctccgccaccctcgccatcaccggcctccagaccggcgacgagggcgactactactgcggcgcctgggacacctccctctccgccggcggcgtcttcggcaccggcaccaaggtcaccgtcctc

SEQ ID NO: 18028 - RNA, 333 nt, synthetic construct
  misc_feature 1..333: note = derived and/or modified sequence opt2 from anti-HIV_048-046059_VR-Chain
  source 1..333: mol_type = other RNA
cagtccgtcctcacccagcccccctccgtctccgccgcccccggccagaacgtcaccatctcctgctccggcacctcctccaacatcgagaacaactacgtctcctggtaccagaccctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18029 - RNA, 333 nt, synthetic construct
  misc_feature 1..333: note = derived and/or modified sequence opt2 from anti-HIV_048-043568_VR-Chain
  source 1..333: mol_type = other RNA
cagtccgtcctcacccagcccccctccgtctccgccgcccccggccagaaggtcaccatctcctgctccggctccgactccaacatcggctccaactacgtctcctggtaccagcagctccccggcgccgcccccaagctcctcatctacaagaacaacaaccgcccctccggcatccccgaccgcttctccggctccaagtccggcacctccgccaccctcggcatctccggcctccagaccggcgacgaggccgactactactgcggcacctgggacacctccctctccggcggcggcgtcttcggcaccggcaccaaggtcaccgtcctc

SEQ ID NO: 18030 - RNA, 333 nt, synthetic construct
  misc_feature 1..333: note = derived and/or modified sequence opt2 from anti-HIV_048-042713_VR-Chain
  source 1..333: mol_type = other RNA
cagtccgtcctcacccagcccccctccgtctccgccgcccccggccagaaggtcaccatctcctgctccggctcctcctccaacatcggccgccactacgtctcctggtaccagcagctccccggcaccgcccccaagctcctcatctacgacaacaactcccgcccctccggcatccccgaccgcttctccggctccaagtccggcacctccgccaccctcggcatcaccggcctccagaccggcgacgaggccgactactactgcggcacctgggacacctccctcaaccgcggcggcgtcttcggcaccggcaccaaggtcaccgtcctc

SEQ ID NO: 18031 - RNA, 333 nt, synthetic construct
  misc_feature 1..333: note = derived and/or modified sequence opt2 from anti-HIV_048-042440_VR-Chain
  source 1..333: mol_type = other RNA
cagtccgtcctcacccagcccccctccgcctccggcacccccggccagcgcgtcaccatctcctgctccggctcctcctccaacatcggcaccaacaccgtcaactggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 18032 - RNA, 333 nt, synthetic construct
  misc_feature 1..333: note = derived and/or modified sequence opt2 from anti-HIV_048-040511_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcacctccccggcaccgcccccaagctcctcatctacgagaacaacaagcgctcctccggcatccccgagcgcttctccggctcccagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 18033 - RNA, 333 nt, synthetic construct
  misc_feature 1..333: note = derived and/or modified sequence opt2 from anti-HIV_048-039195_VR-Chain
  source 1..333: mol_type = other RNA
cagtccgtcctcacccagcccccctccgtctccgccgcccccggccagcgcgtcaccatctcctgctccggctccacctccaacatcggcaaccactacgtctcctggtaccagcagctccccggcaccgcccccaagctcctcatctacgacaacggcaaccgcccctccggcatccccgaccgcttctccggctccaagtccggcacctccgccaccctcgacatcaccggcctccagaccggcgacgaggccgactactactgcggcacctgggacacctccctcaaccgcggcggcgtcttcggcaccggcaccaaggtcaccgtcctc

SEQ ID NO: 18034 - RNA, 333 nt, synthetic construct
  misc_feature 1..333: note = derived and/or modified sequence opt2 from anti-HIV_048-036935_VR-Chain
  source 1..333: mol_type = other RNA
cagtccgtcctcacccagcccccctccatgtccgccgcccccggcgagcgcgtcaccatctcctgcaccggctcctcctccaacatcggcggctacgacgtccactggtaccagcagctccccggcatcgcccccaagatcctcatctaccgcaactccatccgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 18035 - RNA, 333 nt, synthetic construct
  misc_feature 1..333: note = derived and/or modified sequence opt2 from anti-HIV_048-034478_VR-Chain
  source 1..333: mol_type = other RNA
cagtccgtcctcacccagcccccctccgtctccgccgcccccggccagaaggtcaccatctcctgcaccggctccggctccaacatcggcaacaacgacgtctcctggtaccagcagctccccggcaccgccccccgcctcctcatctacggcgacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18036 - RNA, 333 nt, synthetic construct
  misc_feature 1..333: note = derived and/or modified sequence opt2 from anti-HIV_048-031641_VR-Chain
  source 1..333: mol_type = other RNA
cagtccgtcctcacccagcccccctccgtctccgccgcccccggccagaaggtcaccatctcctgctccggcaacaactccaacatcggcaacaactacgtctcctggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 18037 - RNA, 333 nt, synthetic construct
  misc_feature 1..333: note = derived and/or modified sequence opt2 from anti-HIV_048-029760_VR-Chain
  source 1..333: mol_type = other RNA
cagtccgccctcacccagcccgcctccgtctccggctcctccggccagtccatcaccatctcctgcaccggcaccaactccgacgtcggctacgactacgtctgctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18038 - RNA, 333 nt, synthetic construct
  misc_feature 1..333: note = derived and/or modified sequence opt2 from anti-HIV_048-027970_VR-Chain
  source 1..333: mol_type = other RNA
cagtccgtcctcacccagcccccctccgtctccgccccccccggccagaaggtcaccatctcctgctccggcaccacctccaacatcggctccaactacgtcgcctggtaccagcagttccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcgccacctgggacacctccctctccgccggcggcgtcttcggcaccggcaccaaggtcaccgtcctc

SEQ ID NO: 18039 - RNA, 333 nt, synthetic construct
  misc_feature 1..333: note = derived and/or modified sequence opt2 from anti-HIV_048-027337_VR-Chain
  source 1..333: mol_type = other RNA
cagtccgtcctcacccagcccccctccgtctccgccgcccccggccagaaggtcaccatctcctgctccggctcctactccaacatcggcaacaactacctctcctggtaccagcagctccccggcaccgcccccaagctcctcatctacaagaacaacaagcgcccctccggcgtccccgaccgcttctccggctccaagtccggcgcctccgccaccctcgacatcaccggcctccagaccggcgacgaggccgactactactgcggcatctgggacacctccctctccgccggcggcgtcttcggcaccggcaccaaggtcaccgtcctc

SEQ ID NO: 18040 - RNA, 333 nt, synthetic construct
  misc_feature 1..333: note = derived and/or modified sequence opt2 from anti-HIV_048-027217_VR-Chain
  source 1..333: mol_type = other RNA
cagtccgtcctcacccagcccccctccgtctccgccgcccccggccagaaggtcaccatctcctgctccggctcctcctccatcatcggcaacaactacgtctcctggtaccagcagctccccggcaccgcccccaagctcctcatctacgagaacaacaagcgcccctccggcatccccgaccgcttctccggctccaagtccggcacctccgccaccctcgccatcgccggcctccagaccggcgacgaggccgactactactgcgccacctgggacacctccctctccgccggcggcgtcttcggcaccggcaccaaggtcaccgtcctc

SEQ ID NO: 18041 - RNA, 333 nt, synthetic construct
  misc_feature 1..333: note = derived and/or modified sequence opt2 from anti-HIV_048-026760_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcacctccccggcaccgcccccaagctcctcatctacgacaccgtcaagcgccactccggcgtccccgaccgcttctccggctccaagtccggcacctccgccaccctcggcatctccggcctccagaccggcgacgaggccgactactactgcggcacctgggacacctccctctccgccggcggcgtcttcggctccggcaccaaggtcaccgtcctc

SEQ ID NO: 18042 - RNA, 333 nt, synthetic construct
  misc_feature 1..333: note = derived and/or modified sequence opt2 from anti-HIV_048-024800_VR-Chain
  source 1..333: mol_type = other RNA
cagtccgtcctcacccagcccccctccgtctccgccgcccccggccagaaggtcaccatctcctgctccggctcctactccaacatcggcaacaactacgtctcctggtaccaggtcctccccggcaccgcccccaagctcctcatctacaagaacaacgagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18043 - RNA, 333 nt, synthetic construct
  misc_feature 1..333: note = derived and/or modified sequence opt2 from anti-HIV_048-024313_VR-Chain
  source 1..333: mol_type = other RNA
cagtccgtcctcacccagcccccctccgtctccgccgcccccggccagaaggtcaccatctcctgctccggctcctcctccaccatcggcaactcccacgtctcctggtaccagatcctccccggcaccgcccccaagctcctcatctacaaggacgacaagcgcccctccggcatccccgaccgcttctccggctccaagtccggcacctccgccaccctcggcatcaccggcctccagaccggcgacgaggccgactactactgcggcacctgggacacctccctcaaccgcggcggcgtcttcggcaccggcaccaaggtcaccgtcctc

SEQ ID NO: 18044 - RNA, 333 nt, synthetic construct
  misc_feature 1..333: note = derived and/or modified sequence opt2 from anti-HIV_048-021748_VR-Chain
  source 1..333: mol_type = other RNA
cagtccgtcctcacccagcccccctccgtctccgccgcccccggccagcgcgtcaccatctcctgctccggctccacctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatctccggcctccagaccggcgacgaggccgactactactgcggcacctgggactcctccctctccggcggcggcgtcttcggcaccggcaccaaggtcaccgtcctc

SEQ ID NO: 18045 - RNA, 333 nt, synthetic construct
  misc_feature 1..333: note = derived and/or modified sequence opt2 from anti-HIV_048-020991_VR-Chain
  source 1..333: mol_type = other RNA
cagtccgtcctcacccagcccccctccgcctccggcacccccggccagaaggtcaccatctcctgctccggctcctcctccaccatcggcaacaactacgtctcctggtaccaggtcctccccggcaccgcccccaagctcctcatctacaagaacgacaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 18046 - RNA, 333 nt, synthetic construct
  misc_feature 1..333: note = derived and/or modified sequence opt2 from anti-HIV_048-020340_VR-Chain
  source 1..333: mol_type = other RNA
cagtccgtcctcacccagcccccctccgtctccgccgcccccggccagcgcgtcaccatctcctgctccggctcctcctccaacgtcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggacgcctccctctccgccggcggcgtcttcggcaccggcaccaaggtcaccgtcctc

SEQ ID NO: 18047 - RNA, 333 nt, synthetic construct
  misc_feature 1..333: note = derived and/or modified sequence opt2 from anti-HIV_048-019993_VR-Chain
  source 1..333: mol_type = other RNA
cagtccgtcctcacccagcccccctccgtctccggcgcccccggccagcgcgtcaccatctcctgcaccggctcctcctcctccatcggcggcttcgacgtccactggtaccagcgcctccccggcaccgccccccgcctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18048 - RNA, 333 nt, synthetic construct
  misc_feature 1..333: note = derived and/or modified sequence opt2 from anti-HIV_048-019947_VR-Chain
  source 1..333: mol_type = other RNA
cagtccgtcctcacccagcccccctccgtctccgccgcccccggccagcgcgtcaccatctcctgctccggctcctcctccaacatcggctccaagtacgtctcctggtaccagcagctccccggcaccgcccccaagctcctcatctacgagaactccaagcgcccctccggcatccccgaccgcttctccggctccaagtccggcacctccgccaccctcggcatcaccggcctccagaccggcgacgaggccgactactactgcggcacctgggacacctccctctccaccggcggcgtcttcggcaccggcaccaaggtcaccgtcctc

SEQ ID NO: 18049 - RNA, 333 nt, synthetic construct
  misc_feature 1..333: note = derived and/or modified sequence opt2 from anti-HIV_048-017871_VR-Chain
  source 1..333: mol_type = other RNA
cagtccgtcctcacccagcccccctccgtctccgccgcccccggccagaaggtcaccatctcctgctccggctcctcctccaacatcggcaaccgctacgtctcctggtaccagcagctccccggcaccgcccccaagctcctcatctacaagaacaacaagcgcccctccggcatccccgaccgcttctccggctccaagtccggcacctccgccaccctcggcatcaccggcctccagaccggcgacgaggccgactactactgcggcacctgggacggctccctctccaccggcggcgtcatcggcaccggcaccaaggtcaccgtcctc

SEQ ID NO: 18050 - RNA, 333 nt, synthetic construct
  misc_feature 1..333: note = derived and/or modified sequence opt2 from anti-HIV_048-015931_VR-Chain
  source 1..333: mol_type = other RNA
cagtccgtcctcacccagcccccctccgtctccgccgcccccggccagaaggtcaccatctcctgctccggcggctcctccaacatcggctccacctacgtctcctggtaccagcaggtccccggcaccgcccccaagctcctcatctacgagaacaacaagcgcccctccggcatccccgaccgcttctccggctccaagtccggcacctccgccaccctcgacatcaccggcctccagaccggcgacgaggccgactactactgcggcacctgggacacctccctctccggcggcggcgtcttcggcaccggcaccaaggtcaccgtcctc

SEQ ID NO: 18051 - RNA, 333 nt, synthetic construct
  misc_feature 1..333: note = derived and/or modified sequence opt2 from anti-HIV_048-015920_VR-Chain
  source 1..333: mol_type = other RNA
cagtccctcctcacccagcccccctccgtctccgccgcccccggccagaaggtcaccatctcctgctccggctcctcctccaccatcggcaacaactacgtctcctggtaccaggtcctccccggcaccgcccccaagctcctcatctacaagaacaacgagcgcccctccggcatccccgaccgcttctccggctccaagtccggcacctccgccaccctcggcatcaccggcctccagaccggcgacgaggccgagtactactgcgccacctgggacgcctccctctccggcggcggcgtcttcggcaccggcaccaaggtcaccgtcctc

SEQ ID NO: 18052 - RNA, 333 nt, synthetic construct
  misc_feature 1..333: note = derived and/or modified sequence opt2 from anti-HIV_048-013898_VR-Chain
  source 1..333: mol_type = other RNA
cagtccgtcctcacccagcccccctccgtctccgccgcccccggccagaaggtcaccatctcctgctccggctcctcctccaacatcggcaagcactccgtctcctggtaccagcagctccccggcaccgcccccgagctcctcatctacgacaacaacaaccgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18053 - RNA, 333 nt, synthetic construct
  misc_feature 1..333: note = derived and/or modified sequence opt2 from anti-HIV_048-013429_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaccctcctcatctacgagaacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18054 - RNA, 333 nt, synthetic construct
  misc_feature 1..333: note = derived and/or modified sequence opt2 from anti-HIV_048-012358_VR-Chain
  source 1..333: mol_type = other RNA
cagtccgtcctcacccagcccccctccgtctccgccgcccccggccagaaggtcaccatctcctgctccggctccaactccgccatcggcaacaactacgtctcctggtaccaggtcctccccggcaccgcccccaagctcctcatctacaagaacaacgagcgcccctccggcatccccgaccgcttctccggctccaagtccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 18055 - RNA, 333 nt, synthetic construct
  misc_feature 1..333: note = derived and/or modified sequence opt2 from anti-HIV_048-011158_VR-Chain
  source 1..333: mol_type = other RNA
cagtccgtcctcacccagcccccctccgtctccgccgcccccggccagaaggtcaccatctcctgctccggcatctcctccaacatcggcaacaacgacgtctcctggtaccagcagctccccggcaccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18056 - RNA, 333 nt, synthetic construct
  misc_feature 1..333: note = derived and/or modified sequence opt2 from anti-HIV_048-010720_VR-Chain
  source 1..333: mol_type = other RNA
cagtccgtcctcacccagcccccctccgtctccgccgcccccggccagaaggtcaccatctcctgctccggctcctcctccaacatcggctcccactacgtctcctggtaccagcaggtccccggcaccgccccccgcctcgtcatctacgagaactccaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggctccggcaccaaggtcaccgtcctc

SEQ ID NO: 18057 - RNA, 333 nt, synthetic construct
  misc_feature 1..333: note = derived and/or modified sequence opt2 from anti-HIV_048-009445_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgtccccaagctcctcatctacgacacctacacccgcccctccggcacccccgaccgcttctccggctccaagtccggcacctccgccaccctcgccatcaccggcctccagaccggcgacgaggccgactactactgcggcacctgggacggctccctctccaccggcggcgtcatcggcaccggcaccaaggtcaccgtcctc

SEQ ID NO: 18058 - RNA, 324 nt, synthetic construct
  misc_feature 1..324: note = derived and/or modified sequence opt2 from anti-HIV_048-006126_VR-Chain
  source 1..324: mol_type = other RNA
cagtccgtcctcacccagcccccctccgtctccggcgcccccggccagaaggtcaccatctcctgctccggcatctcctccaacttcggcatctcctggtaccagcaggtccccggcaccgcccccaagctcctcatctacgagaacgacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18059 - RNA, 333 nt, synthetic construct
  misc_feature 1..333: note = derived and/or modified sequence opt2 from anti-HIV_048-005652_VR-Chain
  source 1..333: mol_type = other RNA
cagtccgtcctcacccagcccccctccgtctccgccgcccccggccagaaggtcaccatctcctgctccggctccaactccgccatcggcaacaactacgtctcctggtaccaggtcctccccggcaccgcccccaagctcctcatctacgacacctacaagcgcgcctccggcatccccgaccgcttctccggctccaagtccggcacctccgccaccctcggcatcaccggcctccagaccggcgacgaggccgactactactgcggcacctgggacacctccctctccggcggcggcgtcttcggcaccggcaccaaggtcaccgtcctc

SEQ ID NO: 18060 - RNA, 333 nt, synthetic construct
  misc_feature 1..333: note = derived and/or modified sequence opt2 from anti-HIV_048-005532_VR-Chain
  source 1..333: mol_type = other RNA
cagtccgtcctcacccagcccccctccgtctccgccgcccccggccagaaggtcaccatctcctgctccggcacctcctccaacatcggcaacacctacgtctcctggtaccagcagctccccggcaccgcccccaactacctcatctacaagatcgacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18061 - RNA, 333 nt, synthetic construct
  misc_feature 1..333: note = derived and/or modified sequence opt2 from anti-HIV_048-005189_VR-Chain
  source 1..333: mol_type = other RNA
cagtccgtcctcacccagcccccctccgtctccgccgcccccggccagaaggtcaccatctcctgctccggctccggctccaccatcggcaacaacgacgtctcctggtaccagcagctccccggcgccgcccccaagctcctcatctacgaggacaacaagcgcccctccggcatccccgcccgcttctccggctccaagtccggcacctccgccaccctccgcatcaccggcctccagaccggcgacgaggccgactactactgcggcacctgggactcctccctctccgccggcggcgtcttcggcaccggcacccgcgtctccgtcctc

SEQ ID NO: 18062 - RNA, 333 nt, synthetic construct
  misc_feature 1..333: note = derived and/or modified sequence opt2 from anti-HIV_048-005088_VR-Chain
  source 1..333: mol_type = other RNA
cagtccgtcctcacccagcccccctccgtctccgccgcccccggccagaaggtcaccatctcctgctccggctcctcctccaacatcggcaagaactacgtctcctggtaccagcagctccccggcaccgcccccaagctcctcatctacgacaacaacaaccgcccctccggcatccccgaccgcttctccggctccaagtccggcacctccgccaccctcggcatcaccggcctccagaccggcgacgaggccgactactactgcggcgcctgggacacctccctctccgccggcggcgtcttcggcaccggcaccaaggtcaccgtcctc

SEQ ID NO: 18063 - RNA, 333 nt, synthetic construct
  misc_feature 1..333: note = derived and/or modified sequence opt2 from anti-HIV_048-004023_VR-Chain
  source 1..333: mol_type = other RNA
cagtccgtcctcacccagcccccctccgtctccgccacccccggccagaaggtcaccatctcctgctccggcggctcctccaacatcggcaagaacgacgtctcctggtaccagcagctccccggcaccgcccccaagctcctcatctacgacaccaacaagcgcccctccggcatccccgaccgcttctccgccgcccgctccggcacctccgccaccctcgacatcaccggcctccagaccggcgacgaggccgactactactgcggcacctgggacacctccctctccgccggcggcgtcttcggcaccggcaccaaggtcaccgtcctc

SEQ ID NO: 18064 - RNA, 333 nt, synthetic construct
  misc_feature 1..333: note = derived and/or modified sequence opt2 from anti-HIV_048-001580_VR-Chain
  source 1..333: mol_type = other RNA
cagtccgtcctcacccagcccccctccgtctccgccgcccccggccagaaggtcaccatctcctgctccggctcctcctccaacatcggcaacaactacgtctcctggtaccagcagctccccggcaccgcccccaagctcctcctctacgagaacaacaagcgcccctccggcatccccgaccgcttctccggctccaagtccggcacctccgccaccctcgccatcaccggcctccagaccggcgacgaggccgcctactactgcggcacctgggacggctccctctccaccggcggcgtcatcggcaccggcaccaaggtcaccgtcctc

SEQ ID NO: 18065 - RNA, 333 nt, synthetic construct
  misc_feature 1..333: note = derived and/or modified sequence opt2 from anti-HIV_038-221120_VR-Chain
  source 1..333: mol_type = other RNA
cagtccgtcctcacccagcccccctccgtctccgccgcccccggccagaaggtcaccatctcctgctccggctccacctccaacatcggcaagaactacgtctcctggtaccagcagctccccggcaccgcccccaagctcctcatctacgacaacaacgagcgcccctccggcatccccgaccgcttctccggctccaagtccggcacctccgccaccctcggcatcaccggcctccagaccggcgacgaggccgactactactgcgccacctgggactcctccctctccggcggcggcgtcttcggcaccggcacccgcgtcaccgtcctc

SEQ ID NO: 18066 - RNA, 333 nt, synthetic construct
  misc_feature 1..333: note = derived and/or modified sequence opt2 from anti-HIV_038-197677_VR-Chain
  source 1..333: mol_type = other RNA
cagtccgtcctcacccagcccccctccgtctccgccgcccccggccagaaggtcaccgtctcctgctccggctccaactccaacatcggcaaccactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18067 - RNA, 333 nt, synthetic construct
  misc_feature 1..333: note = derived and/or modified sequence opt2 from anti-HIV_038-196765_VR-Chain
  source 1..333: mol_type = other RNA
cagtccgccctcacccagcccgcctccgtctccggctcccccggccagtccatcaccatctcctgcaccggcacctccggcgacgtcggctacaacctcgtctcctggtaccagcagctccccggcaccgcccccaaggtcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18068 - RNA, 333 nt, synthetic construct
  misc_feature 1..333: note = derived and/or modified sequence opt2 from anti-HIV_038-186200_VR-Chain
  source 1..333: mol_type = other RNA
cagtccgtcctcacccagcccccctccgcctccggcacccccggccagcgcatcaccatctcctgctccggcacctcctccaacatcggctccaacatcgtctcctggtaccagcacctccccggcaccacccccaagctcgtcatcttccgcaacaaccagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18069 - RNA, 333 nt, synthetic construct
  misc_feature 1..333: note = derived and/or modified sequence opt2 from anti-HIV_038-126170_VR-Chain
  source 1..333: mol_type = other RNA
cagtccgtcctcacccagcccccctccgtctccgccccccccggccagaaggtcaccatctcctgctccggcaccacctccaacatcggctccaactacgtcgcctggtaccagcagctccccggcaccgcccccaagctcctcatctacgacaacgtcaagcgccccaccaacatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18070 - RNA, 333 nt, synthetic construct
  misc_feature 1..333: note = derived and/or modified sequence opt2 from anti-HIV_038-108545_VR-Chain
  source 1..333: mol_type = other RNA
cagtccgtcctcacccagcccccctccgcctccggcacccccggccagcgcgtcaccatctcctgctccggctcctcctccaacatcggctacaacaccgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18071 - RNA, 333 nt, synthetic construct
  misc_feature 1..333: note = derived and/or modified sequence opt2 from anti-HIV_038-107263_VR-Chain
  source 1..333: mol_type = other RNA
cagtccgtcctcacccagcccccctccgcctccggcacccccggccagcgcgtcaccatctcctgctccggctcctcctccaacatcggctccaacaccgtcaactggtaccagcaggtccccggcaccgcccccaacctcctcatctactccaacgaccagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18072 - RNA, 333 nt, synthetic construct
  misc_feature 1..333: note = derived and/or modified sequence opt2 from anti-HIV_038-104530_VR-Chain
  source 1..333: mol_type = other RNA
cagtccgtcctcacccagcccccctccgtctccgccgcccccggccagaaggtcaccatctcctgctccggctcctcctccaacatcggctccaactacgtctcctggtaccagcacctccccggcaaggcccccaagctcctcatctacgacaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18073 - RNA, 333 nt, synthetic construct
  misc_feature 1..333: note = derived and/or modified sequence opt2 from anti-HIV_038-099169_VR-Chain
  source 1..333: mol_type = other RNA
cagtccgtcctcacccagcccccctccgcctccggcacccccggccagcgcgtctccatctcctgctccggcatcacctcctccctcggctccaaccacatgtcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18074 - RNA, 333 nt, synthetic construct
  misc_feature 1..333: note = derived and/or modified sequence opt2 from anti-HIV_038-075067_VR-Chain
  source 1..333: mol_type = other RNA
cagtccgtcctcacccagcccccctccgtctccggcgcccccggccagcgcgtcaccatctcctgctccggctcctcctccaccatcggcaacaactacgtctcctggtaccagctcctccccggcaccgcccccaagctcctcatctacaagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18075 - RNA, 333 nt, synthetic construct
  misc_feature 1..333: note = derived and/or modified sequence opt2 from anti-HIV_038-072368_VR-Chain
  source 1..333: mol_type = other RNA
cagtccgtcctcacccagtccccctccgcctccggcacccccggccagcgcgtcaccatctcctgctccggctcctcctccaacatcggcaacaactacgtctcctggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18076 - RNA, 333 nt, synthetic construct
  misc_feature 1..333: note = derived and/or modified sequence opt2 from anti-HIV_038-068503_VR-Chain
  source 1..333: mol_type = other RNA
cagtccgtcctcacccagcccccctccgtctccgccgcccccggccagatggtcaccatctcctgctccggctcccgctccaacatcgagaaccactacgtctcctggtaccagcacctccccggcgccgcccccaagctcctcatctacgacaacggcaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18077 - RNA, 333 nt, synthetic construct
  misc_feature 1..333: note = derived and/or modified sequence opt2 from anti-HIV_038-068016_VR-Chain
  source 1..333: mol_type = other RNA
cagtccgtcctcacccagcccccctccgcctccggcacccccggccagcgcgtcaccatctcctgctccggctcctcctccaacatcgagtccaacttcgtctactggtaccagcagttccccggcaccacccccaagctcctcatctaccgcgacggccagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18078 - RNA, 333 nt, synthetic construct
  misc_feature 1..333: note = derived and/or modified sequence opt2 from anti-HIV_038-063958_VR-Chain
  source 1..333: mol_type = other RNA
cagtccgtcctcacccagcccccctccgtctccggcgcccccggccagcgcgtcaccatctcctgcaccggctcctcctccaacatcggcaactccggcgtccactggtaccagcagctccccggcaccgcccccaagctcctcatctacgagaacaacaagcgcccctccggcatccccgaccgcttctccggctccaagtccggcacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18079 - RNA, 333 nt, synthetic construct
  misc_feature 1..333: note = derived and/or modified sequence opt2 from anti-HIV_038-033733_VR-Chain
  source 1..333: mol_type = other RNA
cagtccgtcctcacccagcccccctccgcctccggcacccccggccagcgcgtcaccatctcctgctccggctcctcctccaacatcggctccaagtacgtctactggtaccagcagctccccggcaccgcccccaagctcctcatctacgacaacgacaagcgcccctccggcatccccgaccgcatctccgcctccaagtccggcacctccgccaccctcgacatcacccgcctccagaccggcgacgaggccgactactactgcggcacctgggactcctccctctccgccggcggcgtcttcggcaccggcaccaaggtcaccgtcctc

SEQ ID NO: 18080 - RNA, 333 nt, synthetic construct
  misc_feature 1..333: note = derived and/or modified sequence opt2 from anti-HIV_038-030557_VR-Chain
  source 1..333: mol_type = other RNA
cagtccgtcctcacccagcccccctccgtctccgccgcccccggccagaaggtcaccatctcctgctccggctcctcctccaccatcggcaacaactacgtctcctggtaccagctcctccccggcaccgcccccaagctcctcatctacaagaacaacaagcgcccctccggcatccccgaccgcttctccggctccaagtccggcacctccgccaccctcggcatcaccggcctccagaccggcgacggcgccgactactactgcggcacctgggacacctccctctccgccggcggcgtcttcggcaccggcaccatcgtcaccgtcctc

SEQ ID NO: 18081 - RNA, 333 nt, synthetic construct
  misc_feature 1..333: note = derived and/or modified sequence opt2 from anti-HIV_038-024298_VR-Chain
  source 1..333: mol_type = other RNA
cagtccgtcctcacccagcccccctccgtctccgccgcccccggccagaaggtcaccatctcctgctccggctcctcctccaacatcggcaactcccacgtctcctggtaccagcagttccccggcaccggccccaagctcctcatctacgagaacgccaagcgcccctccggcatccccgaccgcatctccggctccaagtccgacacctccgccaccctcggcatcaccggcctccagaccggcgacgaggccgactactactgcggcacctgggactcctccctctccgccggcggcgtcttcggcaccggcaccaaggtcaccgtcctc

SEQ ID NO: 18082 - RNA, 333 nt, synthetic construct
  misc_feature 1..333: note = derived and/or modified sequence opt2 from anti-HIV_038-011154_VR-Chain
  source 1..333: mol_type = other RNA
cagtccgtcctcacccagcccccctccgtctccgccgcccccggccagcgcatcaccatctcctgctccggctcctcctccaacatcggcaacaactacgtctcctggtaccagcagctccccggcaccgcccccaagctcctcatctacaagaacaacaagcgcccctccggcatccccgaccgcttctccggctccaagtccggcacctccgccaccctcggcatcaccggcctccagaccggcgacgaggccgactactactgcggcacctgggacacctccctctccgccggcggcgtcttcggcaccggcaccaaggtcaccgtcctc

SEQ ID NO: 18083 - RNA, 318 nt, synthetic construct
  misc_feature 1..318: note = derived and/or modified sequence opt2 from anti-HIV-1_LightChain
  source 1..318: mol_type = other RNA
gagatcgtcctcacccagtcccccggcaccctctccctctcccccggcgagcgcgccaccctctcctgccgcgcctcccagtccgtctccaacaacttcctcgcctggtaccagtacaagcccggccagcccccccgcgtcctcatctacggcacctcccgccgcgcctccggcatccccgaccgcttctccggctccggctccggcaccgacggctccctcaccatctcccgcctcgaggccgaggacttcgccgtctactactgccagcagtacgagttcttcggccagggcacccgcctcgagatgaagcgcacc

SEQ ID NO: 18084 - RNA, 318 nt, synthetic construct
  misc_feature 1..318: note = derived and/or modified sequence opt2 from anti-HIV-1_LightChain
  source 1..318: mol_type = other RNA
gaggtcgtcctcacccagtcccccggcaccctctccctctcccccggcgagcgcgccaccctctcctgccgcgcctcccagtccgtctcccgcaactacctcgcctggtaccagcagaagctcggccacggcccccgcctcctcgtctacgccacctcccgccgcgccaccggcatccccgaccgcttcatcggctcccagtccggcaccgagtacaacctcaccatcacccgcctcgaccccggcgacttcgcccagtacttctgccagcagtacgagttcttcggccccggcacccgcctcgacatcaagcgcacc

SEQ ID NO: 18085 - RNA, 309 nt, synthetic construct
  misc_feature 1..309: note = derived and/or modified sequence opt2 from anti-HIV-1_LightChain
  source 1..309: mol_type = other RNA
gaggtcgtcctcacccagtcccccggcaccctctccctctcccccggcgagcgcgcctccttctcctgcaagtcctcccagtacggccacaccgcctggtaccagcagaagctcggccacggcccccgcctcctcatctacgccacctcccgccgcgccaccggcatccccgaccgcttcatcggctcccagtccggcaccgagtacaacctcaccatcacccgcctcgaccccggcgacttcgcccactacttctgccagcagaacgagttcttcggccccggcacccgcctcgacatgaagcgcacc

SEQ ID NO: 18086 - RNA, 306 nt, synthetic construct
  misc_feature 1..306: note = derived and/or modified sequence opt2 from anti-HIV-1_LightChain
  source 1..306: mol_type = other RNA
gagatcgtcctcacccagtccccctcctccctctccctctcccccggcgagcgcgcctccctctcctgccgcggctcccacggccacgtcgcctggtaccagcacaagcccggccagatcccccgcctcctcatctacgccacctccaagcgcgcctccggcatctccgaccgcttctccggctccggctccggcaccgacgccaccctctccatctcccgcctcgagcccgaggacttcgccgtctacttctgccagcagtacgagttcttcggccagggcacccgcctcgagatcaagcgcacc

SEQ ID NO: 18087 - RNA, 306 nt, synthetic construct
  misc_feature 1..306: note = derived and/or modified sequence opt2 from anti-HIV-1_LightChain
  source 1..306: mol_type = other RNA
gagatcatgctcacccagtcccccggcaccctctccctctcccccggcgagcgcgccaccctctcctgccgcggctcccacggccacgtcgcctggtaccagcagaagcccggccgcatcccccgcctcctcatctacggcacctccaagcgcgcctccggcatccccgaccgcttctccggctccggctccggcaccgacgccaccctcaccatctcccgcctcgagtccgaggacttcgccgtctacttctgccagcagtacgagttcttcggccagggcacccgcctcgacatcaaccgcacc

SEQ ID NO: 18088 - RNA, 309 nt, synthetic construct
  misc_feature 1..309: note = derived and/or modified sequence opt2 from anti-HIV-1_LightChain
  source 1..309: mol_type = other RNA
gagtccgtcctcacccagtcccccggcaccctctccctctcccccggcgagaccgcctccctctcctgcaccgccgccctctacggccacatgacctggtaccagaagaagcccggccagccccccaagctcctcctctacgcctcctccaagcgcgcctccggcatccccgaccgcttctccggctcccagttcggcaagcagtacaccctcatcatcaccaagatggagcccgaggacttcgccgagtactactgccagcagttcgaggtcttcggccagggcacccgcctcgacatgcgccgcacc

SEQ ID NO: 18089 - RNA, 306 nt, synthetic construct
  misc_feature 1..306: note = derived and/or modified sequence opt2 from anti-HIV-1_LightChain
  source 1..306: mol_type = other RNA
gaggtcgtcctcacccagtcccccggcaccctctccctctcccccggcgagcgcgccaccctctcctgccgcggctcccacggccacctctcctggtaccagtacaagcccggccagcccccccgcgtcctcatctacggcacctcccgccgcgcctccggcatccccgaccgcttctccggctccggctccggcaccgacggctccctcaccatctcccgcctcgaggccgaggacttcgccgtctactactgccagcagtacgagttcttcggccagggcacccgcctcgagatgaagcgcacc

SEQ ID NO: 18090 - RNA, 309 nt, synthetic construct
  misc_feature 1..309: note = derived and/or modified sequence opt2 from anti-HIV-1_LightChain
  source 1..309: mol_type = other RNA
gaggtcgtcctcacccagtcccccggcaccctctccctctcccccggcgagcgcgcctccctctcctgcaagtcctcccagtacggccacaccgcctggtaccagcagaagctcggccagggcccccgcctcctcatctacgccacctcccgccgcgccaccggcatccccgaccgcttctccggctcccagtccggcaccgagtacaacctcaccatcacccgcctcgaccccggcgacttcgcccagtacttctgccagcagtacgagttcttcggccccggcacccgcctcgacatcaagcgcacc

SEQ ID NO: 18091 - RNA, 306 nt, synthetic construct
  misc_feature 1..306: note = derived and/or modified sequence opt2 from anti-HIV-1_LightChain
  source 1..306: mol_type = other RNA
gagatcatgctcacccagtcccccggcaccctctccctctcccccggcgagcgcgccaccctctcctgccgcggctcccacggccacgtcgcctggtaccagcagaagcccggccgcatcccccgcctcctcatctacggcacctccaagcgcgcctccggcatccccgaccgcttctccggctccggctccggcaccgacgccaccctcaccatctcccgcctcgagtccgaggacttcgccgtctactactgccagcagtacgagttcttcggccagggcacccgcctcgacatcaagcgcacc

SEQ ID NO: 18092 - RNA, 309 nt, synthetic construct
  misc_feature 1..309: note = derived and/or modified sequence opt2 from anti-HIV-1_LightChain
  source 1..309: mol_type = other RNA
gagtccgtcctcacccagtcccccggcaccctctccctctcccccggcgagaccgcctccctctcctgcaccgccgcctcctacggccacatgacctggtaccagaagaagcccggccagccccccaagctcctcatcttcgccacctccaagcgcgcctccggcatccccgaccgcttctccggctcccagttcggcaagcagtacaccctcaccatcacccgcatggagcccgaggacttcgccggctactactgccagcaggtcgagttcttcggccagggcacccgcctcgagatccgccgcacc

SEQ ID NO: 18093 - RNA, 309 nt, synthetic construct
  misc_feature 1..309: note = derived and/or modified sequence opt2 from anti-HIV-1_LightChain
  source 1..309: mol_type = other RNA
gacatccagatgacccagtccccctcctccctctccgcctccgtcggcgaccgcgtcaccatcacctgccaggcctcccaggacatctccaactacctcaactggtaccagcagaagcccggcaaggcccccaagctcctcatctacgacgcctccaacctcgagaccggcgtcccctcccgcttctccggctccggcttccacaccaccttctccctcaccatctccggcctccagcgcgacgacttcgccacctacttctgcgccgtcctcgagttcttcggccccggcaccaaggtcgacttcaac

SEQ ID NO: 18094 - RNA, 309 nt, synthetic construct
  misc_feature 1..309: note = derived and/or modified sequence opt2 from anti-HIV-1_LightChain
  source 1..309: mol_type = other RNA
gacatccagatgacccagtccccctcctccctctccgcctccgtcggcgaccgcgtcaccatcacctgccaggcctcccaggacatcaccaactacctcaactggtaccagcagaagcccggccgcgcccccaagctcctcgtccacggcgcctccaacctccagcgcggcgtcccctcccgcttctccggctccggcttccacaccaccttcaccctcaccatctcctccctccagcccgacgacgtcgccacctacttctgcgaggtcttccagtggttcggccccggcacccgcgtcgacttcaac

SEQ ID NO: 18095 - RNA, 309 nt, synthetic construct
  misc_feature 1..309: note = derived and/or modified sequence opt2 from anti-HIV-1_LightChain
  source 1..309: mol_type = other RNA
ggcttccagctcacccagtccccctcctccctctccgcctccgtcggcgaccgcgtctccatcaactgccaggccggcgagggcatcggctcctccctcaactggtaccagcagaagcccggccgcgcccccaagctcctcgtccacggcgcctccaacctccagcgcggcgtcccctcccgcttctccggctccggcttccacaccaccttcaccctcaccatctcctccctccagcccgacgacgtcgccacctacttctgcgaggtcttccagtggttcggccccggcacccgcgtcgacttcaac

SEQ ID NO: 18096 - RNA, 309 nt, synthetic construct
  misc_feature 1..309: note = derived and/or modified sequence opt2 from anti-HIV-1_LightChain
  source 1..309: mol_type = other RNA
ggcatccagctcacccagtccccctcctccctctccgtctccgtcggcgaccgcgtcaccatcacctgccgcgcctcccagggcatcggcaactccctcaactggtaccagcagaagcccggcaaggcccccaacctcatggtcttcggcaccaccaagctcaaccgcggcgtcccctcccgcttctccggctccggctccggcaccaccgccaccctcaccatcaactccctccagcccgaggacatcgccacctacttctgccaggtcttcgagttcctcggccccggcaccaagctcgacatgaag

SEQ ID NO: 18097 - RNA, 309 nt, synthetic construct
  misc_feature 1..309: note = derived and/or modified sequence opt2 from anti-HIV-1_LightChain
  source 1..309: mol_type = other RNA
gacatccagatgacccagtccccctcctccctctccgcctccgtcggcgaccgcgtcaccatcacctgccaggccggccagggcatcggctcctccctcaagtggtaccagcagaagcccggccgcgccccccgcctcctcgtccacggcgcctccaacctccaccgcggcgtcccctcccgcttctccggctccggcttccacaccaccttctccctcaccatctccggcctccagcgcgacgacttcgccacctacttctgcgccgtcctcgagttcttcggccccggcaccaaggtcgacttcaac

SEQ ID NO: 18098 - RNA, 309 nt, synthetic construct
  misc_feature 1..309: note = derived and/or modified sequence opt2 from anti-HIV-1_LightChain
  source 1..309: mol_type = other RNA
ggcatccagctcacccagtccccctcctccctctccgcctccgtcggcgaccgcgtcaccatcacctgccaggcctcccagggcatcggctcctccctccagtggtaccagcagaagcccggccgcgcccccaacctcctcgtccacggcgcctccaacctccaccgcggcgtcccctcccgcttctccggctccggcttccacaccaccttctccctcaccatctccggcctccagcgcgacgacttcgccacctacttctgcgccgtcctcgagttcttcggccccggcaccaaggtcgagatcaag

SEQ ID NO: 18099 - RNA, 309 nt, synthetic construct
  misc_feature 1..309: note = derived and/or modified sequence opt2 from anti-HIV-1_LightChain
  source 1..309: mol_type = other RNA
ggcgtccagctcacccagtccccctcctccctctccgcctccgtcggcgaccgcgtctccatcaactgccaggccggccagggcatcggctcctccctcaactggtaccagcagaagcgcggcaaggcccccaagctcctcgtccacggcgcctccaccctccagcgcggcgtcccctcccgcttctccggctccggcttccacaccaccttcaccctcaccatctcctccctccagcccgacgacgtcgccacctacttctgcgaggtcttccagtggttcggccccggcacccgcgtcgacttcaac

SEQ ID NO: 18100 - RNA, 306 nt, synthetic construct
  misc_feature 1..306: note = derived and/or modified sequence opt2 from anti-HIV-1_LightChain
  source 1..306: mol_type = other RNA
tacatccagctcacccagtccccctcctccctctccgcctccatcggcgaccgcgtcaccatcgcctgccgcgcctcccagggcatcggctacgtccactggtaccagcagaagcgcggcaagccccccaagctcctcatccacggcgcctccatcctcgagcgcggcgtcccctcccgcttctccggctccggctccggcaccctcttcaacctcaccgtctccggcctccagcccgaggacttcgccacctacatgtgccaggtcttcgagtccttcggccccggcaccaaggtccagatgaag

SEQ ID NO: 18101 - RNA, 309 nt, synthetic construct
  misc_feature 1..309: note = derived and/or modified sequence opt2 from anti-HIV-1_LightChain
  source 1..309: mol_type = other RNA
ggcatccagctcacccagtccccctcctccctctccgcctccctcggcgaccgcgtcaccatcacctgccaggcctcccagggcatcggctcctccctccagtggtaccagcagaagcccggcaaggcccccaagctcctcgtccacggcgcctccaagctccaccgcggcgtcccctcccgcttctccggctccggcttccacaccaccttctccctcaccatctcctccctccagcccgaggacttcgccacctacctctgccaggtcctcgagttcttcggccccggcaccaaggtcgacttcaac

SEQ ID NO: 18102 - RNA, 309 nt, synthetic construct
  misc_feature 1..309: note = derived and/or modified sequence opt2 from anti-HIV-1_LightChain
  source 1..309: mol_type = other RNA
ggcatccagctcacccagtccccctcctccctctccgcctccgtcggcgacaccgtcaccatcacctgccaggcctcccagggcatcggctcctccctccagtggtaccagcagaagcgcggccgcgcccccaagctcctcgtccacggcgcctccaacctccagggcggcgtcccctcccgcttctccggctccggcttccacaccaccttcaccctcgccatccgcggcctccagcccgacgacttcgccacctacttctgccagtccctcgagttcttcggccccggcaccaaggtcgacatgaag

SEQ ID NO: 18103 - RNA, 306 nt, synthetic construct
  misc_feature 1..306: note = derived and/or modified sequence opt2 from anti-HIV-1_LightChain
  source 1..306: mol_type = other RNA
tacatccagctcacccagtccccctcctccctctccgcctccgtcggcgaccgcgtcaccatcacctgccgcgcctcccaggacatcggctacgtctcctggtacgcccagaagcgcggccgcgcccccaagctcctcatccacggcgcctccggcctcgagcgcggcgtcccctcccgcttctccggctccggctccggcaccctcttcaccctcaccatcgagtccctccagcccgaggacttcgccacctacatgtgccaggtcttcgagtccttcggccccggcaccaaggtcgagatgaag

SEQ ID NO: 18104 - RNA, 309 nt, synthetic construct
  misc_feature 1..309: note = derived and/or modified sequence opt2 from anti-HIV-1_LightChain
  source 1..309: mol_type = other RNA
ggcatccagctcacccagtccccctcctccctctccgcctccgtcggcgaccgcgtctccatcaactgccaggccggccagggcatcggctcctccctcaactggtaccagcagaagcccggccgcgcccccaagctcctcgtccacggcgcctccaacctccagcgcggcgtcccctcccgcttctccggctccggcttccacaccaccttcaccctcaccatctcctccctccagcccgacgacgtcgccacctacttctgcgccgtcttccagtggttcggccccggcacccgcgtcgacttcaac

SEQ ID NO: 18105 - RNA, 366 nt, synthetic construct
  misc_feature 1..366: note = derived and/or modified sequence opt2 from anti-HIV-1_HeavyChain
  source 1..366: mol_type = other RNA
tcccagcagctcgtccagtccggcacccaggtcaagaagcccggcgcctccgtccgcatctcctgccaggcctccggctacaccttcaccgactacgtcctccactggtggcgccaggcccccggccagggcctcgagtggatgggctggatcaagcccgtctacggcgcccgcaactacgcccgccgcttccagggccgcatcgacttctcccgcgacatctaccgcgagatcgcctacatggacctctccggcctccgctccgacgacaccgccctctacttctgcgcccgcgacggctccggcgacgacacctcctggcacctcgacccctggggccagggcaccctcgtcatcgtctccgcc

SEQ ID NO: 18106 - RNA, 366 nt, synthetic construct
  misc_feature 1..366: note = derived and/or modified sequence opt2 from anti-HIV-1_HeavyChain
  source 1..366: mol_type = other RNA
tcccagcagctcgtccagtccggcacccaggtcaagaagcccggcgcctccgtccgcatctcctgccaggcctccggctacaccttcaccgactacctcctccactggtggcgccaggcccccggccagcgcctcgagtggatgggctggatcaagcccgtctacggcgcccgcaactacgcccaccgcttccagggccgcatcaacttcgaccgcgacatctaccgcgagatcgccttcatggacctctccggcctccgctccgacgacaccgccgtctacttctgcgcccgcgacggcggcggcgacgaccgcacctggctcctcgacacctggggccagggcaccctcgtcgtcgtctcctcc

SEQ ID NO: 18107 - RNA, 366 nt, synthetic construct
  misc_feature 1..366: note = derived and/or modified sequence opt2 from anti-HIV-1_HeavyChain
  source 1..366: mol_type = other RNA
caggtccacctcgagcagcccggctccgtcgtccgctggcccggcgcctccctcaccctctcctgcaccgcctccggctacatcttcgtcaactaccacatccactggctccgccaggcccccggccagcgcctcgagctcctcggcaccatcaaccccgtcggcggcgccacctcctacgcccagaagttccgcggccgcctcgtcctcacccgcgacatcggctcctccaccgtcaccctcctcctcaaccacctccgccgcgacgactccgccgtctacttctgcgcccgcgagtccaacgcctccggccgcggccgctccatggaccactggggccgcggctcccgcgtcatcgtctcccag

SEQ ID NO: 18108 - RNA, 366 nt, synthetic construct
  misc_feature 1..366: note = derived and/or modified sequence opt2 from anti-HIV-1_HeavyChain
  source 1..366: mol_type = other RNA
caggtccagctcgtccagtccggcgccgaggtcaagaagcccggcgcctccgtccgcgtctcctgccaggcctccggctacaccttcaccaactacatcctccactggtggcgccaggcccccggccagggcctcgagtggatgggcctcatcaagcccgtctacggcgccgtcaactacgcccgccagttccagggccgcatccagctcacccgcgacatctaccgcgagatcgccttcctcgacctctccggcctccgctccgacgacaccgccgtctactactgcgcccgcgacgagtccggcgacgacctcaagtggcacctccacccctggggccagggcacccaggtcatcgtctccccc

SEQ ID NO: 18109 - RNA, 366 nt, synthetic construct
  misc_feature 1..366: note = derived and/or modified sequence opt2 from anti-HIV-1_HeavyChain
  source 1..366: mol_type = other RNA
caggtccagctcgtccagtccggcgccgaggtcaagaagcccggcgcctccgtccgcatctcctgccaggcctccggctacaccttcaccgactacgtcctccactggtggcgccaggcccccggccagggcctcgagtggatgggctggatcaagcccgtctacggcgcccgcaactacgcccgccgcttccagggccgcatcaacttcgaccgcgacatctaccgcgagatcgcctacatggacctctccggcctccgctccgacgacaccgcccgctacttctgcgcccgcgacggctccggcgacgacacctcctggcacctccacccctggggccagggcaccctcgtcatcgtctccgcc

SEQ ID NO: 18110 - RNA, 366 nt, synthetic construct
  misc_feature 1..366: note = derived and/or modified sequence opt2 from anti-HIV-1_HeavyChain
  source 1..366: mol_type = other RNA
tcccagcagctcgtccagtccggcacccaggtcaagaagcccggcgcctccgtccgcgtctcctgccaggcctccggctacaccttcaccaactacatcctccactggtggcgccaggcccccggccagggcctcgagtggatgggcctcatcaagcccgtctacggcgccgtcaactacgcccgccagttccagggccgcatccagctcacccgcgacatctaccgcgagatcgccttcctcgacctctccggcctccgcaccgacgacaccgccgtctactactgcgcccgcgacgagtccggcgacgacctcaagtggcacctccacccctggggccagggcacccaggtcatcgtctccccc

SEQ ID NO: 18111 - RNA, 366 nt, synthetic construct
  misc_feature 1..366: note = derived and/or modified sequence opt2 from anti-HIV-1_HeavyChain
  source 1..366: mol_type = other RNA
caggtccacctcgagcagtccggctccgtcgtccgctggcccggcgcctccctcaccctctcctgcaccgcctccggctacatcttcgtcaactaccacatccactggctccgccaggcccccggccagcgcctcgagctcatgggcaccatcaaccccgtcggcggcgccacctcctacacccagcgcttccgcggccgcctcgtcctcacccgcgacatcggctccaacaccgtcaccctcctcctcaaccacctccgctccgacgactccgccgtctacttctgcgcccgcgagtccaacgcctccggccgcggccgctccatggaccactggggccgcggctcccacgtcatcgtctccccc

SEQ ID NO: 18112 - RNA, 366 nt, synthetic construct
  misc_feature 1..366: note = derived and/or modified sequence opt2 from anti-HIV-1_HeavyChain
  source 1..366: mol_type = other RNA
tcccagcacctcgtccagtccggcacccaggtcaagaagcccggcgcctccgtccgcgtctcctgccaggcctccggctacaccttcaccaactacatcctccactggtggcgccaggcccccggccagggcctcgagtggatgggcctcatcaagcccgtctacggcgccgtcaactacgcccgccagttccagggccgcatccagctcacccgcgacatctaccgcgacatcgccttcctcgacctctccggcctccgctccgacgacaccgccgtctactactgcgcccgcgacgagtccggcgacgacctcaagtggcacctccacccctggggccagggcacccaggtcatcgtctccccc

SEQ ID NO: 18113 - RNA, 366 nt, synthetic construct
  misc_feature 1..366: note = derived and/or modified sequence opt2 from anti-HIV-1_HeavyChain
  source 1..366: mol_type = other RNA
tcccagcagctcgtccagtccggcacccaggtcaagaagcccggcgcctccgtccgcatctcctgccaggcctccggctacaccttcaccgactacgtcctccactggtggcgccaggcccccggccagggcctcgagtggatgggctggatcaagcccgtctacggcgcccgcaactacgcccgccgcttccagggccgcatcaacttcgaccgcgacatctaccgcgagatcgcctacatggacctctccggcctccgctccgacgacaccgcccgctacttctgcgcccgcgacggctccggcgacgacacctcctggcacctccacccctggggccagggcaccctcgtcatcgtctccgcc

SEQ ID NO: 18114 - RNA, 366 nt, synthetic construct
  misc_feature 1..366: note = derived and/or modified sequence opt2 from anti-HIV-1_HeavyChain
  source 1..366: mol_type = other RNA
caggtccacctcgagcagcccggctccgtcgtccgctggcccggcgcctccctcaccctctcctgcaccgcctccggctacatcttcgtcaactaccacatccactggctccgccaggcccccggccagcgcctcgagctcctcggcaccatcaaccccgtcggcggcgccacctcctacgcccagaagttccgcggccgcctcgtcctcacccgcgacatcggctcctccaccgtcaccctcctcctcaaccacctccgccgcgacgactccgccgtctacttctgcgcccgcgagtccaacgcctccggccgcggccgctccatggaccactggggccgcggcaagcccgtcatcgtctccccc

SEQ ID NO: 18115 - RNA, 321 nt, synthetic construct
  misc_feature 1..321: note = derived and/or modified sequence opt2 from anti-HIV-1_HeavyChain
  source 1..321: mol_type = other RNA
gagatcgtcatgacccagtcccccgccatcctctccgtctcccccggcgaccgcgccaccttctcctgccgcgcctcccagtccgtcaagaacaacctcgcctggtaccagaagcgccccggccaggccccccgcctcctcatcttcgacgcctcctcccgcgcctccggcatccccgcccgcttctccggcggcggctccggcaccgagttcaccctcaccgtcaactccatgcagtccgaggacttcgccacctactactgccagcagtacgaggagtggccccgcaccttcggccagggcaccaaggtcgagatcatg

SEQ ID NO: 18116 - RNA, 321 nt, synthetic construct
  misc_feature 1..321: note = derived and/or modified sequence opt2 from anti-HIV-1_HeavyChain
  source 1..321: mol_type = other RNA
cagatcgtcctcacccagtccccccccaccctctccctctcccccggcgagcgcgccaccctctcctgccgcgcctcccagtccgtcaagaacaacctcgcctggtaccagaagcgccccggccaggccccccgcctcctcatcttcgacacctcctcccgcgcctccaacatccccgcccgcttctccggcggcggctccggcaccgagttcaccctcaccgtcaactccatgcagtccgaggacttcgccacctactactgccagcagtacgaggagtggccccgcaccttcggccagggcaccaaggtcgagatcatc

SEQ ID NO: 18117 - RNA, 321 nt, synthetic construct
  misc_feature 1..321: note = derived and/or modified sequence opt2 from anti-HIV-1_HeavyChain
  source 1..321: mol_type = other RNA
gagatcgtcatgacccagtcccccgccgtcctctccgtctcccccggcgaccgcgccaccctctcctgccgcgcctcccagtccgtcaagaacaacctcgcctggtaccagaagcgccccggccaggccccccgcctcctcatcttcgacacctcctcccgcgcctccaacatccccgcccgcttctccggcggcggctccggcaccgagttcaccctcaccgtcaactccatgcagtccgaggacttcgccacctactactgccagcagtacgaggagtggccccgcaccttcggccagggcaccaaggtcgagatcaac

SEQ ID NO: 18118 - RNA, 321 nt, synthetic construct
  misc_feature 1..321: note = derived and/or modified sequence opt2 from anti-HIV-1_HeavyChain
  source 1..321: mol_type = other RNA
gagatcgtcctcacccagtccccccccaccctctccgtctcccccggcgaggccgccaccctctcctgccgcgcctcccagtccgtcaagaacaacctcgcctggtaccacctcaaggccggccaggccccccgcctcctcatcttcgacgcctcctcccgcgccggcgacgcccccgcccgcgtctccggctccggctacggcaccgagttcaccctcaccgtcaactccgtccagtccgaggacttcggcgactactactgccagcagtacgaggagtggccccgcaccttcggccagggcaccaaggtcgacctccgc

SEQ ID NO: 18119 - RNA, 321 nt, synthetic construct
  misc_feature 1..321: note = derived and/or modified sequence opt2 from anti-HIV-1_HeavyChain
  source 1..321: mol_type = other RNA
gagatcgtcatgacccagtccccccccaccctctccgtctcccccggcgagaccgccaccctctcctgccgcgcctcccagaacgtcaagaacaacctcgcctggtaccagctcaagcccggccaggccccccgcctcctcatcttcgacgcctcctcccgcgccggcggcatccccgaccgcttctccggctccggctacggcaccgacttcaccctcaccgtcaactccgtccagtccgaggacttcggcgactacttctgccagcagtacgaggagtggccccgcaccttcggccagggcaccaaggtcgacctccgc

SEQ ID NO: 18120 - RNA, 321 nt, synthetic construct
  misc_feature 1..321: note = derived and/or modified sequence opt2 from anti-HIV-1_HeavyChain
  source 1..321: mol_type = other RNA
gagatcgtcatgacccagtcccccgccgtcctctccgtctcccccggcgaccgcgccaccctctcctgccgcgcctcccagtccgtcaagaacaacctcgcctggtaccagaagcgccccggccaggccccccgcctcctcatcttcgacacctcctcccgcgcctccaacatccccgcccgcttctccggcggcggctccggcaccgagttcaccctcaccgtcaactccatgcagtccgaggacttcgccacctactactgccagcagtacgaggagtggccccgcaccttcggccagggcaccaaggtcgagatcatc

SEQ ID NO: 18121 - RNA, 399 nt, synthetic construct
  misc_feature 1..399: note = derived and/or modified sequence opt2 from anti-HIV-1_HeavyChain
  source 1..399: mol_type = other RNA
gaggtccacctccaggagtccggccccggcctcgtccgccccctcgagaccctctccctcacctgcaccgcctccggcgcctccatccgcggcggcgagtggggcgacaacgactaccactggggctgggtccgccactcccccgagaagggcctcgagtggatcggctccatccactggcgcggcaccacccactacaacgcccccttccgcggccgcgccaccctctccatcgacacctcccgcaaccagttcttcctccgcctcacctccatgaccgccgacgacaccgccgtctactactgcgtcaagcacaagtaccacgacatcgtcatggtcgtccccatcgccggctggttcgacccctggggccagggcctccaggtcaccgtctccgcc

SEQ ID NO: 18122 - RNA, 399 nt, synthetic construct
  misc_feature 1..399: note = derived and/or modified sequence opt2 from anti-HIV-1_HeavyChain
  source 1..399: mol_type = other RNA
gaggtccacctccaggagtccggccccggcctcgtccgccccctcgagaccctctccctcacctgcaccgcctccggcgcctccatccgcggcggcgagtggggcgacaacgactaccactggggctgggtccgccactcccccgagaagggcctcgagtggatcggctccatccactggcgcggcaccacccactacaacgcccccttccgcggccgcgccaccctctccatcgacacctcccgcaaccagttcttcctccgcctcacctccatgaccgccgacgacaccgccgtctactactgcgtcaagcacaagtaccacgacatcgtcatggtcgtccccatcgccggctggttcaacccctggggccagggcctccaggccaccgtcccctcc

SEQ ID NO: 18123 - RNA, 399 nt, synthetic construct
  misc_feature 1..399: note = derived and/or modified sequence opt2 from anti-HIV-1_HeavyChain
  source 1..399: mol_type = other RNA
caggtccagctcaaggagtccggccccggcctcgtcaagccctccgagaccctctccctcacctgcaccgtctccggcggctccatgcgcggcaccgactggggcgagaacgacttccactacggctggatccgccactcctccgccgagggcctcgagtggatcggctccatccactggcgcggcaccacccactacaagatgtccttccgctcccgcgccaccatctccatcgacacctccaacaaccgcttctccctcatgttctccttcgtcaccgccgaggacaccgccgtctactactgcgcccgccacaagtaccacgacatcttccgcgtcgtccccgtcgccggctggttcgacccctggggccagggcctcctcgtcaccgtctcctcc

SEQ ID NO: 18124 - RNA, 399 nt, synthetic construct
  misc_feature 1..399: note = derived and/or modified sequence opt2 from anti-HIV-1_HeavyChain
  source 1..399: mol_type = other RNA
gaggtccacctccaggagtccggccccggcctcgtccgccccctcgagaccctctccctcacctgcaccgcctccggcgcctccatccgcggcggcgagtggggcgacaacgactaccactggggctgggtccgccactcccccgagaagggcctcgagtggatcggctccatccactggcgcggcaccacccactacaacgcccccttccgcggccgcgccaccctctccatcgacacctccaagaaccagttctccctccgcctcacctccatgaccgccgacgacaccgccgtctactactgcgtcaagcacaagtaccacgacatcgtcatggtcgtccccttcgccggctggttcgacccctggggccagggcctccgcgtcaccgtctccgcc

SEQ ID NO: 18125 - RNA, 399 nt, synthetic construct
  misc_feature 1..399: note = derived and/or modified sequence opt2 from anti-HIV-1_HeavyChain
  source 1..399: mol_type = other RNA
gaggtccacctccaggagtccggccccggcctcgtccgccccctcgagaccctctccctcacctgcaccgcctccggcgcctccatccgcggcggcgagtggggcgacaacgactaccactggggctgggtccgccactcccccgagaagggcctcgagtggatcggctccatccactggcgcggcaccacccactacaacgcccccttccgcggccgcgccaccctctccatcgacacctccaagaaccagttcttcctccgcctcacctccatgaccgccgacgacaccgccgtctactactgcgtcaagcacaagtaccacgacatctgcatggtcgtccccatcgccggctggttcgacccctggggccagggcctccaggtcaccgtctcccag

SEQ ID NO: 18126 - RNA, 399 nt, synthetic construct
  misc_feature 1..399: note = derived and/or modified sequence opt2 from anti-HIV-1_HeavyChain
  source 1..399: mol_type = other RNA
caggtccacctccaggagtccggccccggcctcgtccgccccctcgagaccctctccctcacctgcaccgcctccggcgcctccatccgcggcggcgagtggggcgacaacgactaccactggggctgggtccgccactcccccgagaagggcctcgagtggatcggctccatccactggcgcggcaccacccactacaacgcccccttccgcggccgcgccaccctctccatcgacacctcccgcaaccagttcttcctccgcctcacctccatgaccgccgacgacaccgccgtctactactgcgtcaagcacaagtaccacgacatcgtcatggtcgtccccatcgccggctggttcgacccctggggccagggcctccaggtcaccgtctcctcc

SEQ ID NO: 18127 - RNA, 399 nt, synthetic construct
  misc_feature 1..399: note = derived and/or modified sequence opt2 from anti-HIV-1_HeavyChain
  source 1..399: mol_type = other RNA
caggtccacctccaggagtccggccccggcctcgtccgccccctcgagaccctctccctcacctgcaccgcctccggcgcctccatccgcggcggcgagtggggcgacaacgactaccactggggctgggtccgccactcccccgagaagggcctcgagtggatcggctccatccactggcgcggcaccacccactacaacgcccccttccgcggccgcgccaccctctccatcgacacctcccgcaaccagttcttcctccgcctcacctccatgaccgccgacgacaccgccgtctactactgcgtcaagcacaagtaccacgacatcgtcatggtcgtccccatcgccggctggttcgacccctggggccagggcctccgcgtcaccgtctcccag

SEQ ID NO: 18128 - RNA, 399 nt, synthetic construct
  misc_feature 1..399: note = derived and/or modified sequence opt2 from anti-HIV-1_HeavyChain
  source 1..399: mol_type = other RNA
caggtccacctccaggagtccggccccggcctcgtccgccccctcgagaccctctccctcacctgcaccgcctccggcgcctccatccgcggcggcgagtggggcgacaacgactaccactggggctgggtccgccactcccccggcaagggcctcgagtggatcggctccatccactggcgcggcaccacccactacaacgcccccttccgcggccgcgccaccctctccatcgacaccttccgcaaccagttcttcctccgcctcacctccatgaccgccgacgacaccgccgtctactactgcgtcaagcacaagtaccacgacatcgtcatggtcgtccccatcgccggctggttcgacccctggggccagggcctccaggtcaccgtctcccag

SEQ ID NO: 18129 - RNA, 399 nt, synthetic construct
  misc_feature 1..399: note = derived and/or modified sequence opt2 from anti-HIV-1_HeavyChain
  source 1..399: mol_type = other RNA
gaggtccacctccaggagtccggccccggcctcgtccgccccctcgagaccctctccctcacctgcaccgcctccggcgcctccatccgcggcggcgagtggggcgacaacgactaccactggggctgggtccgccactcccccgagaagggcctcgagtggatcggctccatccactggcgcggcaccacccactacaacgcccccttccgcggccgcgccaccctctccatcgacacctcccgcaaccagttcttcctccgcctcacctccatgaccgccgacgacaccgccgtctactactgcgtcaagcacaagtaccacgacatcgtcatggtcgtccccatcgccggctggttcgacccctggggccagggcctccgcggcaccgtctccgcc

SEQ ID NO: 18130 - RNA, 393 nt, synthetic construct
  misc_feature 1..393: note = derived and/or modified sequence opt2 from anti-HIV-1_HeavyChain
  source 1..393: mol_type = other RNA
caggtccagctcgtccagtccggcgccgtcatcaagacccccggctcctccgtcaagatctcctgccgcgcctccggctacaacttccgcgactactccatccactgggtccgcctcatccccgacaagggcttcgagtggatcggctggatcaagcccctctggggcgccgtctcctacgcccgccagctccagggccgcgtctccatgacccgccagctctcccgcgaccccgacgaccccgactggggcgtcgcctacatggagttctccggcctcacccccgccgacaccgccgagtacttctgcgtccgccgcggctcctgcgactactgcggcgacttcccctggcagtactggggccagggcaccgtcgtcgtcgtctcctccgcc

SEQ ID NO: 18131 - RNA, 393 nt, synthetic construct
  misc_feature 1..393: note = derived and/or modified sequence opt2 from anti-HIV-1_HeavyChain
  source 1..393: mol_type = other RNA
caggtccagctcgtccagtccggcgccgtcatcaagacccccggctcctccgtcaagctctcctgccgcgcctccggctacaacttccgcgactactccatccactgggtccgcctcatccccgacaagggcttcgagtggatcggctggatcaagcccctctggggcgccgtctcctacgcccgccagctccagggccgcgtctccatgacccgccagctctcccaggaccccgacgaccccgactggggcgtcgcctacatggagttctccggcctcacccccgccgacaccgccgagtacttctgcgtccgccgcggctcctgcgactactgcggcgacttcccctggcagtactggggccagggcaccgtcgtcgtcgtctcctccgcc

SEQ ID NO: 18132 - RNA, 303 nt, synthetic construct
  misc_feature 1..303: note = derived and/or modified sequence opt2 from anti-HIV-1_LightChain
  source 1..303: mol_type = other RNA
accgccggcctcacccagtcccccggcaccctctccctctcccccggcgagcgcgccatcctctcctgccgcacctcccagtacggctccctcgcctggtaccagcagcgccccggccaggccccccgcctcgtcatctacgccggcctcacccgcgccaccggcatccccgaccgcttctccggctcccgctggggcgccgagtacaacctcaccatctccaacctcgagtccgaggacttcggcgtctactactgccagcagtacgacttcttcggccagggcaccaaggtccaggtcgac

SEQ ID NO: 18133 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcc

SEQ ID NO: 18134 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttcgagaagtacaccggcggccagggctggtacttcgacctctggggccgcggcaccctcatcgtcgtctcctccgcc

SEQ ID NO: 18135 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcc

SEQ ID NO: 18136 - RNA, 387 nt, synthetic construct
  misc_feature 1..387: note = derived and/or modified sequence opt2 from anti-HIV-1_HeavyChain
  source 1..387: mol_type = other RNA
caggtccagctcgtccagtccggcgccgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctccgcc

SEQ ID NO: 18137 - RNA, 387 nt, synthetic construct
  misc_feature 1..387: note = derived and/or modified sequence opt2 from anti-HIV-1_HeavyChain
  source 1..387: mol_type = other RNA
caggtccagctcgtccagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcc

SEQ ID NO: 18138 - RNA, 387 nt, synthetic construct
  misc_feature 1..387: note = derived and/or modified sequence opt2 from anti-HIV-1_HeavyChain
  source 1..387: mol_type = other RNA
caggtccagctcgtccagtccggcctcgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcc

SEQ ID NO: 18139 - RNA, 387 nt, synthetic construct
  misc_feature 1..387: note = derived and/or modified sequence opt2 from anti-HIV-1_HeavyChain
  source 1..387: mol_type = other RNA
caggtccagctcgtccagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcggctccgtcgacttccgcgaccgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcc

SEQ ID NO: 18140 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggctccggcgtcaagaagcccggcgcctccgtccgcgtctcctgctggacctccgagggcatcttcgagaagtccgagctcatccactgggtccgccaggcccccggccagggcctcgagtggatcggctgggtcaagaccgtcaccggcgccgtcaacttcggccaccagatctccgaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcc

SEQ ID NO: 18141 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgaggtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcc

SEQ ID NO: 18142 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgaggtcaagcgccccggcgcctccgtcaaggtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcc

SEQ ID NO: 18143 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttcatgtccggcggccagggctggtacttcgacctctggggccgcggcaccgtcatcgtcgtctcctccgcc

SEQ ID NO: 18144 - RNA, 387 nt, synthetic construct
  misc_feature 1..387: note = derived and/or modified sequence opt2 from anti-HIV-1_HeavyChain
  source 1..387: mol_type = other RNA
caggtccagctcgtcccctccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcc

SEQ ID NO: 18145 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttctacgccggcggccagggctggtacttcgacctctggggccgcggcaccctcatcgtcgtctcctccgcc

SEQ ID NO: 18146 - RNA, 387 nt, synthetic construct
  misc_feature 1..387: note = derived and/or modified sequence opt2 from anti-HIV-1_HeavyChain
  source 1..387: mol_type = other RNA
caggtccagctcgtccagtccggcgccgaggtcaagaagcccggctcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagtcccgctactccggcgaccagggctcctacttcgacctctggggccgcggcaccctcatcatcgtctcctccgcc

SEQ ID NO: 18147 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtcaaggtctcctgcaaggcctccggctacaccttcacctcctactacatgcactgggtccgccaggcccccggccagggcctcgagtggatcggctgggtcaagcccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcc

SEQ ID NO: 18148 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtccaggtctcctgcaaggcctccggctaccccttcaccaagtactacatgcactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcc

SEQ ID NO: 18149 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtcaaggtctcctgcaaggcctccggctacaccttcaccggctactacatgcactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcc

SEQ ID NO: 18150 - RNA, 402 nt, synthetic construct
  misc_feature 1..402: note = derived and/or modified sequence opt2 from anti-HIV-1_HeavyChain
  source 1..402: mol_type = other RNA
caggtccagctcgtccagtccggctccggcgtcaagaagcccggcgcctccgtccgcgtctcctgccgcgcctccgaggacctcttcggcgacgagatcatctacgacgacgaggtcatccactggctccgccaggtccccggccagcgccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctccgcc

SEQ ID NO: 18151 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcggcggcgtcaagaagcccggcgcctccgcctccttctcctgccgcacctccgaggaccccttcgacaacgagttcttcgactccgagttcatgcactgggtccgcctcacccccggccagcgccccgagtggatgggctggatgaacccccgctccggcggcgtcaactacgccggccagttccgcccccgcatgtccatgtggcgcgaccgcgagctctccaccgcctacatggagctccgcgacctcaccttcgccgacaccggcctctacttctgcgcccgccgcaaggaggacgactacgactggtactacgacctctggggccgcggcgcccacatcatcgtctccgccgcc

SEQ ID NO: 18152 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcc

SEQ ID NO: 18153 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccggcgccgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcc

SEQ ID NO: 18154 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccgaggccgaggtcaagaagcccggcgcctccatgaccgtctcctgcgagaccgccgacgaggacatcttcgacgccgcctacatgcactgggtccgccaggcccccggccagaccttcgagtggctcggctggatgaagcccgtcaccggcgccgtcaactacgcccgcaagttccagggccgcatctccttctaccgcacccgcgagctcgccatcgcctacatggacctccgcgacctccgcttcgacgacaccgccgtctacttctgcgcccgcaagaccgccggcgacgtctccggcgacaaccgcggctacttcttcgacctctggggccgcggctcccgcgtcatcgtctcctccgcc

SEQ ID NO: 18155 - RNA, 420 nt, synthetic construct
  misc_feature 1..420: note = derived and/or modified sequence opt2 from anti-HIV-1_HeavyChain
  source 1..420: mol_type = other RNA
cagtcccacctcgagcagtccggctccgccatgaagaagcccggcgcctccgtccgcgtctcctgctggacctccgaggacatcttcgacaccaccgagctcctctgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctactactgcgcccgccagaagttcgcctcccgctactccggcgaccagggctcctacttcgacctctggggccgcggcaccctcatcatcgtctcctccgcctccaccaagggcccctccgtcttcccccacgacctc

SEQ ID NO: 18156 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaacggccccatcggcctccccccccgctccgcc

SEQ ID NO: 18157 - RNA, 423 nt, synthetic construct
  misc_feature 1..423: note = derived and/or modified sequence opt2 from anti-HIV-1_HeavyChain
  source 1..423: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctccgcctccaccaagggcccctcctcctcccccaccatctgc

SEQ ID NO: 18158 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18159 - RNA, 411 nt, synthetic construct
  misc_feature 1..411: note = derived and/or modified sequence opt2 from anti-HIV-1_HeavyChain
  source 1..411: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcctccctccaccagggcccctccggcctcccccacgac

SEQ ID NO: 18160 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18161 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctactactgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 18162 - RNA, 384 nt, synthetic construct
  misc_feature 1..384: note = derived and/or modified sequence opt2 from anti-HIV-1_HeavyChain
  source 1..384: mol_type = other RNA
caggtccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18163 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 18164 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctgc

SEQ ID NO: 18165 - RNA, 411 nt, synthetic construct
  misc_feature 1..411: note = derived and/or modified sequence opt2 from anti-HIV-1_HeavyChain
  source 1..411: mol_type = other RNA
caggtccagctcgtccagtccggcgccgaggtcaagaagcccggcgcctccgtcaaggtctcctgcaaggcctccggctacaccttcacctcctactacatgcactgggtccgccaggcccccggccagggcctcgagtggatcggctgggtcaagcccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcctccaccaagggccccgtcgtcttccccaccatctgc

SEQ ID NO: 18166 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18167 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctggatcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18168 - RNA, 420 nt, synthetic construct
  misc_feature 1..420: note = derived and/or modified sequence opt2 from anti-HIV-1_HeavyChain
  source 1..420: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagcgcggcggccagggctggtacttcgacctctggggccgcggcaccctcatcgtcgtctcctccgcctccaccgagggcccctcccgctccttcccccagatcctccgc

SEQ ID NO: 18169 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatctgcgtctcctccgcctccccccgcgcccaccgctcctccccccgctccgcc

SEQ ID NO: 18170 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccgcggcgacaccgccacctactactgcgcccgccagaagttcgagtcccgctacaccggcggccagggctggtacttcgacctctggggccgcggcacccacatcgtcgtctcctcc

SEQ ID NO: 18171 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcatcgtctcctcc

SEQ ID NO: 18172 - RNA, 423 nt, synthetic construct
  misc_feature 1..423: note = derived and/or modified sequence opt2 from anti-HIV-1_HeavyChain
  source 1..423: mol_type = other RNA
cagtcccacctcgagcagtccggctccgccatgaagaagcccggcgcctccgtccgcgtctcctgctggacctccgaggacatcttcgacaccacctccatcttcatcggctgcgaccgccccctcgacaaggactggtccggcctcggcggctccaagctctccctcgccccctccatcttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctc

SEQ ID NO: 18173 - RNA, 399 nt, synthetic construct
  misc_feature 1..399: note = derived and/or modified sequence opt2 from anti-HIV-1_HeavyChain
  source 1..399: mol_type = other RNA
cgcgagtacctcgagcagtccggcggcggcgtcaagaagctcggcgcctccgtccgcgtctcctgccgcgcctccgaggacctcttcggcgacgaggtcatctacgacgacgagctcatccactggctccgccaggtccccggccagcgccccgagtggatgggctggatccgccccaagaccggcgcccgcaaccaggcccgccagttccagccccgcatcaacctctcccgcgaccgcgccctcaacaccgcctacctcgacctctcctccctcacctccgccgactccgccacctacttctgcgcccgccagaccttcaagcccgacttctacttcgccgaccagggctggtccttcaacctctggggccgcggcgcccgcgtcatcgtctcctcc

SEQ ID NO: 18174 - RNA, 384 nt, synthetic construct
  misc_feature 1..384: note = derived and/or modified sequence opt2 from anti-HIV-1_HeavyChain
  source 1..384: mol_type = other RNA
caggtccacctcgtccagtccggcgccgaggtcaagaagcccggctcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagtcccgctactccggcgaccagggctcctacttcgacctctggggccgcggcaccctcatcatcgtctcctcc

SEQ ID NO: 18175 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttccccaccatctgc

SEQ ID NO: 18176 - RNA, 441 nt, synthetic construct
  misc_feature 1..441: note = derived and/or modified sequence opt2 from anti-HIV-1_HeavyChain
  source 1..441: mol_type = other RNA
cgcgagttcctcgagcagtccggcggcggcgtcaagaagctcggcgcctccctccgcgtctcctgccgcgcctccgaggacctcttcggcgacgagttcatctacgacgacgaggtcatccactggctccgccaggtccccggccagcgccccgagtggatgggctggatccgccccaagaccggcgcccgcaaccaggccacccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctccgcctccaccaagggcccctccgtcttcccccacgactccgcc

SEQ ID NO: 18177 - RNA, 399 nt, synthetic construct
  misc_feature 1..399: note = derived and/or modified sequence opt2 from anti-HIV-1_HeavyChain
  source 1..399: mol_type = other RNA
cgcgagtacctcgagcagtccggcggcggcgtcaagaagctcggcgcctccctccgcgtctcctgccgcgcctccgaggacctcttcggcgacgagatcatctacgacgacgaggtcatccactggctccgccaggtccccggccagcgccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18178 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18179 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18180 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggcaccggcgtcaagaagcccggcgcctccgtccgcgtctcctgctggacctccgaggacatcttcgagaagtccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccagatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctc

SEQ ID NO: 18181 - RNA, 399 nt, synthetic construct
  misc_feature 1..399: note = derived and/or modified sequence opt2 from anti-HIV-1_HeavyChain
  source 1..399: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccggc

SEQ ID NO: 18182 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccacgaccgcgacctcttcaccgcccacatggacatccgcggcctcacccagggcgacaccgccacctacttctgcgcccgccagaagttctacgccggcggccagggctggtacttcgacctctggggccgcggcaccctcatctgcgtctcctccgcctccaccaagggcccctccggcctccccccccgctcc

SEQ ID NO: 18183 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 18184 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctactactgcgcccgccagaagttcgagcgcggcggccagggctggtacttcgacctctggggccgcggcaccctcatcgtcgtctcctccgcctccaccaagggcccctccgtcttccccaccatctac

SEQ ID NO: 18185 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctactactgcgcccgccagaagttcgagtcccgctacaccggcggccagggctggtacttcgacctctggggccgcggcacccacatcgtcgtctcctcc

SEQ ID NO: 18186 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctactactgcgcccgccagaagttctacaagggcggccagggctggtacttcgacctctggggccgcggcaccctcatcgtcgtctcctccgcctccaccaagggcccctccgtcttccccaccatctgc

SEQ ID NO: 18187 - RNA, 399 nt, synthetic construct
  misc_feature 1..399: note = derived and/or modified sequence opt2 from anti-HIV-1_HeavyChain
  source 1..399: mol_type = other RNA
cgcgagtacctcgagcagtccggcggcggcgtcaagaagcccggcgcctccgtccgcgtctcctgccgcgcctccgaggacctcttcggcgacgagatcatctacgacgacgaggtcatccactggctccgccaggtccccggccagcgccccgagtggatgggctggatccgccccaagaacggcggccgcaaccaggcccgccagttccagccccgcatctccctcacccgcgaccgcgccctcaacaccgcctacctcgacctcaactccctcacctccgccgactccggcacctacttctgcgcccgccagaccttcaagcccgacttctacttcgccgaccagggctggtccttcaacctctggggccgcggcgcccgcgtcatcgtctcctcc

SEQ ID NO: 18188 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18189 - RNA, 420 nt, synthetic construct
  misc_feature 1..420: note = derived and/or modified sequence opt2 from anti-HIV-1_HeavyChain
  source 1..420: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttccccaccatctgc

SEQ ID NO: 18190 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagtccgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18191 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctcccccaagggcccctccggcctccccccccgctccgcc

SEQ ID NO: 18192 - RNA, 411 nt, synthetic construct
  misc_feature 1..411: note = derived and/or modified sequence opt2 from anti-HIV-1_HeavyChain
  source 1..411: mol_type = other RNA
caggtccagctcgtccagtccggcgccgaggtcaagaagcccggcgcctccgtcaaggtctcctgcaaggcctccggctacaccttcaccacctacggcatctcctgggtccgccaggcccccggccagggcctcgagtggatcggctgggtcaagaccgtcaccggcgccgtcaacttcggccaccagatctccgaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18193 - RNA, 417 nt, synthetic construct
  misc_feature 1..417: note = derived and/or modified sequence opt2 from anti-HIV-1_HeavyChain
  source 1..417: mol_type = other RNA
caggcccagctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18194 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctactactgcgcccgccagaagttcgagcgcggcggccagggctggtacttcgacctctggggccgcggcaccctcatcgtcgtctcctcc

SEQ ID NO: 18195 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctactactgcgcccgccagaagttcgagtcccgctacaccggcggccagggctggtacttcgacctctggggccgcggcacccacatcgtcgtctcctcc

SEQ ID NO: 18196 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttccccaccatctgc

SEQ ID NO: 18197 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtccagaagcccggcgcctccgtcaccgtctcctgcaaggcctccggctacaccctcatctcctacggcatctcctgggtccgccaggcccccggccagggccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18198 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcctccgcaagaaggagctcatccactgggtccgccaggcccccggccagggcctcgagtggatcggctgggtcaagaccgtcaccggcaccgtcaacttcggctcctccgacttccgccagcgcgtctccctcacccgcgaccgcgacctcttcaccgcccacatggacatccgcggcctcacccagggcgacaccgccacctacctctgcgcccgccagaagttcgagcgcggcggccagggctggatcttcgacctctggggccgcggcaccctcatcgccgtctcctccgcctccaccaagggcccctccgtcttcccccacgacctc

SEQ ID NO: 18199 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaacggccccatcggcctcccccaccgctccgcc

SEQ ID NO: 18200 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcggcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctcc

SEQ ID NO: 18201 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccggcctcccccacggctccgcc

SEQ ID NO: 18202 - RNA, 423 nt, synthetic construct
  misc_feature 1..423: note = derived and/or modified sequence opt2 from anti-HIV-1_HeavyChain
  source 1..423: mol_type = other RNA
caggtccagtacggccgcgaggccggcgccggcatgaagaagcccggcgcctccatgaccgtctcctgcaagaccgccgacgaggacatcttcgacgccgcctacatgcaccgcgtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttccccaccatctac

SEQ ID NO: 18203 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 18204 - RNA, 423 nt, synthetic construct
  misc_feature 1..423: note = derived and/or modified sequence opt2 from anti-HIV-1_HeavyChain
  source 1..423: mol_type = other RNA
caggtccagctcgtccagtccgaggccgagctcaagaagcccggcgcctccgtctccgtctcctgcaaggcctccggctactccttcacctcctacggcatctcctgggtccgccaggtccccggccagggcctcgagtggatcgcctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctccgcctccaccaagggcccctccgtcttcccccacgacctccgc

SEQ ID NO: 18205 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctactactgcgcccgccagaagttcgagcgcggcggccagggctggtacttcgacctctggggccgcggcaccctcatcgtcgtctcctccgcctccaccaagggcccctccgtcttcccccacgacctc

SEQ ID NO: 18206 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtccagaagcccggcgcctccgtcaccgtctcctgcaaggcctccggctacaccctcatctcctacggcatctcctgggtccgccaggcccccggccagggccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctactactgcgcccgccagaccttcaagcccgacttctacttcgccgaccagggctggtccttcaacctctggggccgcggcgcccacttcatcgtctcctcc

SEQ ID NO: 18207 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccagatctgc

SEQ ID NO: 18208 - RNA, 378 nt, synthetic construct
  misc_feature 1..378: note = derived and/or modified sequence opt2 from anti-HIV-1_HeavyChain
  source 1..378: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatctgcgtctcctccgcc

SEQ ID NO: 18209 - RNA, 438 nt, synthetic construct
  misc_feature 1..438: note = derived and/or modified sequence opt2 from anti-HIV-1_HeavyChain
  source 1..438: mol_type = other RNA
cagggctacctcgcccagtccggcggcggcgtcaagaagcccggcacctccgcctccttctcctgccgcacctccgacgacatctacgacaacgagttcttcgactccgccttcatgcactgggtccgcctcatccccggccagcgccccgagtggatgggctggatgaacccccgctccggcgccgtcaactacgcccgccagctccagccccgcgtctccatgtaccgcgaccgcgacctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctccgcctccaccaagggcccctccgtcctcccccacgacctccgc

SEQ ID NO: 18210 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcacccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccgctccgcc

SEQ ID NO: 18211 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagaagaaggagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctc

SEQ ID NO: 18212 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctactactgcgcccgccagaagttcgagtcccgctacaccggcggccagggctggtacttcgacctctggggccgcggcacccacatcgtcgtctcctcc

SEQ ID NO: 18213 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctactactgcgcccgccagaagttctacgccggcggccagggctggtacttcgacctctggggccgcggcaccctcatcgtcgtctcctccgcctccaccaagggcccctccgtcttccccaccatctgc

SEQ ID NO: 18214 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18215 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 18216 - RNA, 408 nt, synthetic construct
  misc_feature 1..408: note = derived and/or modified sequence opt2 from anti-HIV-1_HeavyChain
  source 1..408: mol_type = other RNA
caggtccagctcgtccactccggcgccgaggtcaagaagcccggcgcctccatgaaggtctcctgcaagacctccggctactccttcaccggctactacatgcactgggtccgccaggcccccggccagggcctcgagtggatgggctggatcaacccctcctccaacgacaccaactacgcccagaagttccagggccgcgtcaccatgacccgcgacacctccatcaacaccgcctacatggagctctcccgcctccgctccggcgacaccgccatctacttctgcgcccgccagaagttctacgccggcggccagggctggtacttcgacctctggggccgcggcaccctcatcgtcgtctcctccgcctccaccaagggcccctccgtcttccccaccatctgc

SEQ ID NO: 18217 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgccgcttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18218 - RNA, 414 nt, synthetic construct
  misc_feature 1..414: note = derived and/or modified sequence opt2 from anti-HIV-1_HeavyChain
  source 1..414: mol_type = other RNA
cagggcaccctcgagcagtcctggtccgaggtcaagaagctcggcgcctccgtccgcgtctcctgctggacctccgaggacatcttcaagaccgagctcatccactgggtccgccaggcccccggccagggcctcgagtggatcggcggcatgaaggccgtctccggcgccgtcaactacggctccctcgacttccgccaccgcgtctccctcacccccgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18219 - RNA, 423 nt, synthetic construct
  misc_feature 1..423: note = derived and/or modified sequence opt2 from anti-HIV-1_HeavyChain
  source 1..423: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatctgcgtctcctccgcctccacccgcgcccaccgcctccccccccgctccgcc

SEQ ID NO: 18220 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccccccgcgcccaccgctcctccccccgctccgcc

SEQ ID NO: 18221 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgactccgcc

SEQ ID NO: 18222 - RNA, 414 nt, synthetic construct
  misc_feature 1..414: note = derived and/or modified sequence opt2 from anti-HIV-1_HeavyChain
  source 1..414: mol_type = other RNA
caggcccacctcgtccagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18223 - RNA, 414 nt, synthetic construct
  misc_feature 1..414: note = derived and/or modified sequence opt2 from anti-HIV-1_HeavyChain
  source 1..414: mol_type = other RNA
caggcccagctcgagcagtccggctccggcgtcaagaagcccggcgcctccgtccgcgtctcctgctggacctccgaggacatcttcaagaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18224 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggccgcgaggtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18225 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcatctccctcacccgcgaccgcgacctcttcaccgcccacatggacatccgcggcctcacccagggcgacaccgccacctactactgcgcccgccagaagttcgagtcccgctacaccggcggccagggctggtacttcgacctctggggccgcggcacccacatcgtcgtctcctcc

SEQ ID NO: 18226 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctactactgcgcccgccagaagttctacaagggcggccagggctggtacttcgacctctggggccgcggcaccctcatcgtcgtctcctcc

SEQ ID NO: 18227 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaaggtctcctgcaaggcctccggctacaccttcaccgactactacctccactgggtccgccaggcccccggccagggcctcgactgggtcggctggatcaaccccaactccggcggcaccaactacgcccagaagttccagggccgcgtcgccatgacccgcgacacctccctctcctccgtctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18228 - RNA, 414 nt, synthetic construct
  misc_feature 1..414: note = derived and/or modified sequence opt2 from anti-HIV-1_HeavyChain
  source 1..414: mol_type = other RNA
caggccgacctcgagcagtccggctccggcgtcaagaagcccggcgcctccgtccgcgtctcctgctggacctccgaggacatcttcgagcgcaccaactacgtccactgggtccgccaggcccccggccgcggcctcgagtggatcggctggtccaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctc

SEQ ID NO: 18229 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18230 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18231 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagctcggcgcctccgtccgcgtctcctgctggacctccgaggacatcttcgagcgcaccaacctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctc

SEQ ID NO: 18232 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccggcgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18233 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcaccgtctcctcc

SEQ ID NO: 18234 - RNA, 429 nt, synthetic construct
  misc_feature 1..429: note = derived and/or modified sequence opt2 from anti-HIV-1_HeavyChain
  source 1..429: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccggcctcccccccaccatctgccgc

SEQ ID NO: 18235 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18236 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18237 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcggccgcgacctcttcaccgcccacatggacatccgcggcctcacccagggcgacaccgccacctactactgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18238 - RNA, 411 nt, synthetic construct
  misc_feature 1..411: note = derived and/or modified sequence opt2 from anti-HIV-1_HeavyChain
  source 1..411: mol_type = other RNA
caggcccacctcggcgccaactggtccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccagatc

SEQ ID NO: 18239 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18240 - RNA, 423 nt, synthetic construct
  misc_feature 1..423: note = derived and/or modified sequence opt2 from anti-HIV-1_HeavyChain
  source 1..423: mol_type = other RNA
caggcccagctcgagcagtccggcgtcggcgtcaagaagcccggcgcctccgtccgcgtctcctgcctcgcctccgaggacatcttcaagaccgagctcatccactgggtccgccaggcccccggccagggcctcgagtggatcggctgggtcaagaccgtcaccggcgccgtcaacttcggctcccagatcttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 18241 - RNA, 411 nt, synthetic construct
  misc_feature 1..411: note = derived and/or modified sequence opt2 from anti-HIV-1_HeavyChain
  source 1..411: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcgcccaccagatctccgaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctgc

SEQ ID NO: 18242 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatctgcgtctcctcc

SEQ ID NO: 18243 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18244 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18245 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgagggcgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18246 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18247 - RNA, 378 nt, synthetic construct
  misc_feature 1..378: note = derived and/or modified sequence opt2 from anti-HIV-1_HeavyChain
  source 1..378: mol_type = other RNA
caggtctacatggagcagcccggcgtcgaggtcaccaagcccggcgcctccgtcaccctctcctgcaagaccgccgaggacgtcttcgacgccgcctacatgcactgggtccgccaggcccccggccagaccttcgagtggctcggctggatcaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18248 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcatcgtctcctcc

SEQ ID NO: 18249 - RNA, 384 nt, synthetic construct
  misc_feature 1..384: note = derived and/or modified sequence opt2 from anti-HIV-1_HeavyChain
  source 1..384: mol_type = other RNA
caggcccacctcgtccagtccggctccgaggtcaagaagcccggcgccttcgtccgcgtctcctgctggacctccgaggacatcttcgaggagaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18250 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgcaaggcctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18251 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccgaggtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18252 - RNA, 375 nt, synthetic construct
  misc_feature 1..375: note = derived and/or modified sequence opt2 from anti-HIV-1_HeavyChain
  source 1..375: mol_type = other RNA
caggcccacctcgtccagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18253 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgagcgcggcggccagggctggtacttcgacctctggggccgcggcaccctcatctgcgtctcctcc

SEQ ID NO: 18254 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagccccgcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18255 - RNA, 381 nt, synthetic construct
  misc_feature 1..381: note = derived and/or modified sequence opt2 from anti-HIV-1_HeavyChain
  source 1..381: mol_type = other RNA
caggtccagctcgagcaggccggcgccggcgtcaagaagcccggcccctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18256 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18257 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcaggccggcgccggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18258 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgcctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18259 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccgcggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18260 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggcgccggcgtcaaggagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcctcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18261 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18262 - RNA, 384 nt, synthetic construct
  misc_feature 1..384: note = derived and/or modified sequence opt2 from anti-HIV-1_HeavyChain
  source 1..384: mol_type = other RNA
caggcccacctcgtccagtccgcctccggcgtcaagcgccccggcgcctccgtccgcgtctcctgctggacctccgaggacatcttcgagcgcaccgagctcatctactgggtccgccaggcccccggccagggcctcgagtggatcggctgggtcaagaccgtctccggcgccgtcaacttcggctcccaggacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18263 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18264 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcgagggctacatgatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18265 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatctgcgtctcctcc

SEQ ID NO: 18266 - RNA, 375 nt, synthetic construct
  misc_feature 1..375: note = derived and/or modified sequence opt2 from anti-HIV-1_HeavyChain
  source 1..375: mol_type = other RNA
caggcccacctcgtccagtccggctccggcgtcaagaagtccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18267 - RNA, 378 nt, synthetic construct
  misc_feature 1..378: note = derived and/or modified sequence opt2 from anti-HIV-1_HeavyChain
  source 1..378: mol_type = other RNA
caggtctacatggagcgcgccggcgccggcgtcaagaagcccggcgcctccgtcaccctctcctgcaagaccgccgacgaggacgtcttcggcgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18268 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18269 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18270 - RNA, 384 nt, synthetic construct
  misc_feature 1..384: note = derived and/or modified sequence opt2 from anti-HIV-1_HeavyChain
  source 1..384: mol_type = other RNA
caggcccacctcgtccagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcgccggcgccgtcaacttctcctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18271 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagtccggcgcctccgcccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18272 - RNA, 369 nt, synthetic construct
  misc_feature 1..369: note = derived and/or modified sequence opt2 from anti-HIV-1_HeavyChain
  source 1..369: mol_type = other RNA
ctcctccagctcgtccagtccggcgccgaggtcaagaagcccggcgcctccgtcaaggtcacctgcaaggcctccggctacaccttcaccggctacatccactgggtccgccaggcccccggccagggcctcgagtggatcggctgggtcaaggccgtctccggcgccgtcaactacggctccctcgacttccgccaccgcgtctccctcacccacgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18273 - RNA, 369 nt, synthetic construct
  misc_feature 1..369: note = derived and/or modified sequence opt2 from anti-HIV-1_HeavyChain
  source 1..369: mol_type = other RNA
caggtccagctcgtccagtccggcgccgaggtcaagaagcccggcgcctccgtcaaggtctcctgcaaggcctccggctgcaccttcaccggctactacatgcactgggtccgccaggcccccggccagggcctcgagtggatgggctggatcaaccccaactccggcggcaccaactacgcccagaagttccagggccgcgtcaccatgacccgcgacacctccatctccaccgcctacatggagctctcccgcctccgctccgacgacaccgccgtctactactgcgcccgccagaagttcgcccgcggcgaccagggctggttcttcgacctctggggccgcggcaccctcatcgtcgtctcctcc

SEQ ID NO: 18274 - RNA, 369 nt, synthetic construct
  misc_feature 1..369: note = derived and/or modified sequence opt2 from anti-HIV-1_HeavyChain
  source 1..369: mol_type = other RNA
caggtccagctcgtccagtccggcaccgagctccgcaagcccggcgcctccgtcaaggtctcctgcaaggcctccggctacaccttctccggctcctacatccactgggtccgccaggcccccggccagggcctcgagtgggtcggctggatcaacccctcctccggcgccacccagtgcgccaagaagttccaggacaaggtcaccatgacccgcgacaccaccaacaacaccgtctacatggaggtcaaccgcctcatctccgacgacaccgccacctacttctgcgcccgccagaagttcgcccgcggcgaccagggctggttcttcgacctctggggccgcggcaccctcatcgtcgtctcctcc

SEQ ID NO: 18275 - RNA, 372 nt, synthetic construct
  misc_feature 1..372: note = derived and/or modified sequence opt2 from anti-HIV-1_HeavyChain
  source 1..372: mol_type = other RNA
caggtcctcctcgtccagtccggcgccgaggtcaagaagcccggctcctccgtcaaggtctcctgcaagacctccggcgactccctcaccaagtacgccctccactgggcccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18276 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcaccgaggtcaagacccccggcgcctccgtcaaggtctcctgcaaggcctccggctacaccttcaccaactacgacatcaactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18277 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgacgaggtcaagaagcccggcgcctccgtcaaggtctcctgcaaggcctccggcaagggcttccccacctccctcgtcacctgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18278 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggctcctccgtcaaggtctcctgcaagacctccggcgacatcctcaccaactacggcctcaactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18279 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtccgcgtctcctgcaagacctccggctaccccttctcccgctacggcatctcctgggtccgccaggcccccggccagggcctcgtctggatggcctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18280 - RNA, 372 nt, synthetic construct
  misc_feature 1..372: note = derived and/or modified sequence opt2 from anti-HIV-1_HeavyChain
  source 1..372: mol_type = other RNA
cgcgagcagctcgtccagtccggcgccgaggtcaagaagcccggcgcctccgtcaaggtctcctgcaagacctccggcaacaccttcggctcctacgacttcaactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18281 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtcaaggtctcctgcaaggcctccggctacaccttcacctcctactacatgcactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18282 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtcaaggtctcctgcaaggcctccggctacaccttcacctcctactacatgcactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18283 - RNA, 372 nt, synthetic construct
  misc_feature 1..372: note = derived and/or modified sequence opt2 from anti-HIV-1_HeavyChain
  source 1..372: mol_type = other RNA
caggtccagctcggccagtccggcgccgagatgaagaagcccggctcctccgtcaaggtctcctgcaaggcctccggcggcaccttccgccactcccccatctcctgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18284 - RNA, 369 nt, synthetic construct
  misc_feature 1..369: note = derived and/or modified sequence opt2 from anti-HIV-1_HeavyChain
  source 1..369: mol_type = other RNA
caggtccagctcgtccagtccggcgccgaggtccgcacccccggcgcctccgtcaaggtctcctgcaaggcctccggctacaacttcatcgcctaccacgtccactgggtccgccaggcccccggccagggcctcacctggatgggctggatcaaccccgactccggcgacaccgtctacgcccagaacttcgtcgaccgcgtcatgatgacccgcaacacctccatccagaccgtctacctcgagctcaacgtcctcaccctcgaggacaccgccacctacttctgcgcccgccagaagttcgcccgcggcgaccagggctggttcttcgacctctggggccgcggcaccctcatcgtcgtctcctcc

SEQ ID NO: 18285 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtcaaggtctcctgcaaggcctccggctacaccttcaccgtctactacatgcactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18286 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18287 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtcaaggtctcctgcaaggcctccggctacaccttcatcggctactacatgcactgggtccgccaggcccccggccagggcctcgagtggatgggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18288 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18289 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagctcggcgcctccgtccgcgtctcctgctggacctccgaggacatcttcaaggaccgcatcgaccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18290 - RNA, 375 nt, synthetic construct
  misc_feature 1..375: note = derived and/or modified sequence opt2 from anti-HIV-1_HeavyChain
  source 1..375: mol_type = other RNA
caggtccagctcgcccagtccggcgccgaggtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18291 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatctccaaggccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18292 - RNA, 372 nt, synthetic construct
  misc_feature 1..372: note = derived and/or modified sequence opt2 from anti-HIV-1_HeavyChain
  source 1..372: mol_type = other RNA
accgcccacctcgagcagtccggctccggcgtccgccgccccggcgcctccgtccgcgtctcctgctggacctccggcgacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18293 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagcgccccggcgcctccgtccgcgtctcctgctggacctccgaggacatcttcaacaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18294 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18295 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtccgcgtctcctgcaaggcctccggctacaccttcaccgcctactacatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18296 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccgagtccaagaagcccggcgcctccgtccgcgtctcctgctggtcctccgaggacatcttcaagaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18297 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccgaggtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18298 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcaggtctgggccggcgtcaagaagctcggcgcctccgtccgcgtctcctgctggacctccgaggacatcttcaagaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18299 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctccaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18300 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18301 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18302 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccggcggcatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18303 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18304 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18305 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18306 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18307 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacctcgtccaccagatctccgaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18308 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcggccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18309 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18310 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18311 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18312 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18313 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggatcggctgggtcaagaccgtctccggcgccgtcaacctcgcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18314 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgacggcgacctcttcaccgcccacatggacatccgcggcctcacccagggcgacaccgccacctacttctgcgcccgccagaagttctacgccggcggccagggctggtacttcgacctctggggccgcggcaccctcatcatcgtctcctcc

SEQ ID NO: 18315 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacctccgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18316 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18317 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18318 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggccaccagatctccgaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18319 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18320 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagctcggcgcctccgtccgcgtctcctgctggacctccgaggacatcctcaagaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18321 - RNA, 372 nt, synthetic construct
  misc_feature 1..372: note = derived and/or modified sequence opt2 from anti-HIV-1_HeavyChain
  source 1..372: mol_type = other RNA
gtccgctccgtcgtccagtgcgaggccggcgtcaagaagcccggcgcctccgtcaagatctcctgcgccacctccggctacgccttcaccctctactacctccactgggtccgccaggcccccggccagggcctcgagtggatcggctgggtcaagaccgtcaccggcgccgtcaacttcggctccgcctacttccgccaccgcgtctccctcacccccgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18322 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgcctcgactccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18323 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18324 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtcaagtcctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18325 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18326 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctggatgaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18327 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccgaggtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18328 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagctcggcgcctccgtccgcgtctcctgctggacctccggcgacatcttcgagcgcaccgagctcatccactgggtccgccaggcccccggccagggcctcgagtggatcggctgggtcaaggccgtctccggcgccgtcaactacggctccctcgacttccgccagcgcgtctccctcacccgcgaccgcgacctcttcaccgcccacatcgacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18329 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctgggcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18330 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctcccagaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18331 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18332 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcctccgcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18333 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18334 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18335 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18336 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcggctccgtcgacttccgcgaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18337 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtcccgctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaacttcggctcccccaacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18338 - RNA, 375 nt, synthetic construct
  misc_feature 1..375: note = derived and/or modified sequence opt2 from anti-HIV-1_HeavyChain
  source 1..375: mol_type = other RNA
cagtcctacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18339 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18340 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18341 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18342 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18343 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18344 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18345 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18346 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18347 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18348 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18349 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18350 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagctcggcgcctccgtccgcgtctcctgctggacctccgaggacatcttcgagcgcaccgagctcatccactgggtccgccaggcccccggccagggcctcgagtggatcggctggatgaaggccgtctccggcgccgtcaactacggctccctcgacttccgccaccgcgtctccctcacccgcgaccgcgacctctccaccgcccacatcgacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18351 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18352 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18353 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18354 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatgggcatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18355 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtcttcctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18356 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18357 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcccaggacttccgcgaccgcttctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18358 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacgccaccggcctcatctactgggtccgccaggcccccggccagggcctcgagtggatcggctgggtcaagatcgtctccggcaccgtcaacttcgcctccctcgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18359 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcctacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18360 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacctctgcgcccgccagaagttcgcccgcggcgaccagggctggttcttcgacctctggggccgcggcaccctcatcgtcgtctcctcc

SEQ ID NO: 18361 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18362 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18363 - RNA, 375 nt, synthetic construct
  misc_feature 1..375: note = derived and/or modified sequence opt2 from anti-HIV-1_HeavyChain
  source 1..375: mol_type = other RNA
caggcccaccccgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18364 - RNA, 375 nt, synthetic construct
  misc_feature 1..375: note = derived and/or modified sequence opt2 from anti-HIV-1_HeavyChain
  source 1..375: mol_type = other RNA
cgcgcccacctcgagcagtccggctccggcgtccgcaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18365 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18366 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18367 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcacccacatcgtcgtctcctcc

SEQ ID NO: 18368 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18369 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18370 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18371 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcaccgagggcgacaccgccacctacttctgcgcccgccagaagttctacgccggcggccagggctggtacttcgacctctggggccgcggcaccctcatcgtcgtctcctcc

SEQ ID NO: 18372 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgccaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18373 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18374 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18375 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacctctgcgcccgccagaagttcgagcgcggcggccagggctggatcttcgacctctggggccgcggcaccctcatcgccgtctcctcc

SEQ ID NO: 18376 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18377 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18378 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggatcggctgggtcaagaccgtctccggcgccgtcaacttcggctccaccgacttccgcgagcgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18379 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18380 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatctgcggcctcacccagggcgacaccgccacctacttctgcgcccgccagaagttctacgccggcggccagggctggtacttcgacctctggggccgcggcaccctcatcgtcgtctcctcc

SEQ ID NO: 18381 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccgaggcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18382 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18383 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtcaagcgccccggcgcctccgtccgcgtctcctgctggacctccgaggacatcttcgagcgcaccgagctcatctactgggtccgccaggcccccggccagggcctcgagtggatcggctgggtcaagaccgtctccggcgccgtcaacttcggctcccaggacttccgcgaccgcttctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18384 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18385 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgaccccttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18386 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccggcctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18387 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaaggccgtctccggcaccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18388 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18389 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18390 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacccacttctgcgcccgccagaagttcgcccgcggcgaccagggctggttcttcgacctctggggccgcggcaccctcatcgtcgtctcctcc

SEQ ID NO: 18391 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18392 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18393 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18394 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18395 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgagggcatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcgccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18396 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcgccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttctacgccggcggccagggctggtacttcgacctctggggccgcggcaccctcatcgtcgtctcctcc

SEQ ID NO: 18397 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18398 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaactacggctccctcaacttccgctcccgcatctccctcacccgcgaccgcgacctcttcaccgcccacatggacatccgcggcctcaccgagggcgacaccgccacctacttctgcgcccgccagaagttctacgccggcggccagggctggtacttcgacctctggggccgcggcaccctcatcgtcgtctcctcc

SEQ ID NO: 18399 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18400 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatccgctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18401 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccagatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18402 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcgcccaccagatctccgaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18403 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggtcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18404 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18405 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18406 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18407 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacctctgcgcccgccagaagttcgagcgcggcggccagggctggtacttcgacctctggggccgcggcaccctcatcgtcgtctcctcc

SEQ ID NO: 18408 - RNA, 372 nt, synthetic construct
  misc_feature 1..372: note = derived and/or modified sequence opt2 from anti-HIV-1_HeavyChain
  source 1..372: mol_type = other RNA
cgccacacctgggagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18409 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcaccgagggcgacaccgccacctacttctgcgcccgccagaagttctacgccggcggccagggctggtacttcgacctctggggccgcggcaccctcatcgtcgtctcctcc

SEQ ID NO: 18410 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18411 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggccccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18412 - RNA, 375 nt, synthetic construct
  misc_feature 1..375: note = derived and/or modified sequence opt2 from anti-HIV-1_HeavyChain
  source 1..375: mol_type = other RNA
cgcgcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18413 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18414 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18415 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18416 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgagctcaagaagcccggctcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18417 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgtctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18418 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggtcgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18419 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccgcctacttctgcgcccgccagaagttcgcccgcggcgaccagggctggttcttcgacctctggggccgcggcaccctcatcgtcgtctcctcc

SEQ ID NO: 18420 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtccgcaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18421 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18422 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18423 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18424 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18425 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcggctccgtcgacttccgcgaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18426 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18427 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18428 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagcgccccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatgggcatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18429 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18430 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagctcggcgcctccgtccgcgtcccctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18431 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18432 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18433 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtccgccgccccggcgcctccgtccgcgtctcctgctggacctccgaggacatcttcgagcgctccgagctcatctactgggtccgccaggcccccggccgcggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18434 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18435 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttctacgccggcggccagggctggtacttcgacctctggggccgcggcaccctcatcgtcgtctcctcc

SEQ ID NO: 18436 - RNA, 375 nt, synthetic construct
  misc_feature 1..375: note = derived and/or modified sequence opt2 from anti-HIV-1_HeavyChain
  source 1..375: mol_type = other RNA
caggtccagctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18437 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18438 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18439 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggaccggctgggtcaagaccgtctccggcgccgtcaacttcggctccaccgacttccgcgagcgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18440 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18441 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18442 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18443 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcggcaccgccacctacttctgcgcccgccagaagttctacgccggcggccagggctggtacttcgacctctggggccgcggcaccctcatcgtcgtctcctcc

SEQ ID NO: 18444 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatctgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18445 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtccgcaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18446 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18447 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18448 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggcctctccgacttccgccagcgcgtctccctcacccgcgaccgcggcctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18449 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18450 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgagcgcggcggccagggctggtacttcgacctctggggccgcggcaccctcatcgtcgtctcctcc

SEQ ID NO: 18451 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18452 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgcaaccgcatctccctctcccgcgaccgcgacctctccaccgcccacatggacatccgcggcctcacccaggacgacaccgccacctacttctgcgcccgccagaagttcgagcgcggcggccagggctggatcttcgacctctggggccgcggcaccctcatcgccgtctcctcc

SEQ ID NO: 18453 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcaccgaggtcaagaagcccggcgcctccgtccgcgtctcctgcaaggcctccggctacaccttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18454 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagcgcggcggccagggctggatcttcgacctctggggccgcggcaccctcatcgccgtctcctcc

SEQ ID NO: 18455 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18456 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18457 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18458 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcgtccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18459 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18460 - RNA, 375 nt, synthetic construct
  misc_feature 1..375: note = derived and/or modified sequence opt2 from anti-HIV-1_HeavyChain
  source 1..375: mol_type = other RNA
caggcccaccgcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18461 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgcctcgcctccgaggacatcttcaagaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18462 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgagcgcggcggccagggctggatcttcgacctctggggccgcggcaccctcatcgccgtctcctcc

SEQ ID NO: 18463 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18464 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18465 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18466 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18467 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18468 - RNA, 372 nt, synthetic construct
  misc_feature 1..372: note = derived and/or modified sequence opt2 from anti-HIV-1_HeavyChain
  source 1..372: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacctcgcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18469 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18470 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgcaaccgcatctccctctcccgcgaccgcgacctctccaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18471 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18472 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18473 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18474 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18475 - RNA, 375 nt, synthetic construct
  misc_feature 1..375: note = derived and/or modified sequence opt2 from anti-HIV-1_HeavyChain
  source 1..375: mol_type = other RNA
caggcccgccccggcacctccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18476 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcaccgagggcgacaccgccacctacttctgcgcccgccagaagttcgagcgcggcggccagggctggatcttcgacctctggggccgcggcaccctcatcgccgtctcctcc

SEQ ID NO: 18477 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccatctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18478 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaactccggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18479 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcgccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18480 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcgtcaccgtctcctcc

SEQ ID NO: 18481 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18482 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18483 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18484 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgcctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18485 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgagcgcggcggccagggctggtacttcgacctctggggccgcggcaccctcatcgtcgtctcctcc

SEQ ID NO: 18486 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggatcggctgggtcaagaccgtctccggcgccgtcaacttcggctccaccgacttccgcgagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18487 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgtcgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18488 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18489 - RNA, 375 nt, synthetic construct
  misc_feature 1..375: note = derived and/or modified sequence opt2 from anti-HIV-1_HeavyChain
  source 1..375: mol_type = other RNA
caggcctacctcgagcagtccggctccatcatgaagaagcccggcgcctccgtccgcgtctcctgctggacctccgaggacatcttcgaccgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18490 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgcctcgcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18491 - RNA, 375 nt, synthetic construct
  misc_feature 1..375: note = derived and/or modified sequence opt2 from anti-HIV-1_HeavyChain
  source 1..375: mol_type = other RNA
gaggcccacctcgagcagtccggctccggcgtcaagaagcccggcgcctccgtccgcgtctcctgctggacctccgaggacatcttcgagcgcaccgagctcacccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18492 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatctacgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18493 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18494 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18495 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggcccccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18496 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgagcgcggcggccagggctggatcttcgacctctggggccgcggcaccctcatcgccgtctcctcc

SEQ ID NO: 18497 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtccgcaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18498 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18499 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcgccctcatcgtcgtctcctcc

SEQ ID NO: 18500 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18501 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18502 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgcaaccgcatctccctctcccgcgaccgcgacctctccaccgcccacatggacatccgcggcctcacccaggacgacaccgccacctacttctgcgcccgccagaagttctacgccggcggccagggctggtacttcgacctctggggccgcggcaccctcatcgtcgtctcctcc

SEQ ID NO: 18503 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18504 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18505 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacgccgccacctacttctgcgcccgccagaagttcgagcgcggcggccagggctggtacttcgacctctggggccgcggcaccctcatcgtcgtctcctcc

SEQ ID NO: 18506 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttctacgccggcggccagggctggtacttcgacctctggggccgcggcaccctcatcgtcgtctcctcc

SEQ ID NO: 18507 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcgccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18508 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcgcccagggcgacaccgccacctacttctgcgcccgccagaagttcgagcgcggcggccagggctggtacttcgacctctggggccgcggcaccctcatcgtcgtctcctcc

SEQ ID NO: 18509 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgcaaccgcatctccctctcccgcgaccgcgacctctccaccgcccacatggacatccgcggcctcacccaggacgacaccgccacctacttctgcgcccgccagaagttcgagcgcggcggccagggctggtacttcgacctctggggccgcggcaccctcatcgtcgtctcctcc

SEQ ID NO: 18510 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18511 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18512 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccgcgcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18513 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18514 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18515 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18516 - RNA, 375 nt, synthetic construct
  misc_feature 1..375: note = derived and/or modified sequence opt2 from anti-HIV-1_HeavyChain
  source 1..375: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttctacgccggcggccagggctggtacttcgacctctggggccgcggcaccctcatcgtcgtctcctcc

SEQ ID NO: 18517 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccggcctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18518 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacgtcttcgagcgcaccgagctcatccactgggtccgccaggcccccggccagggcctcgagtggatcggctgggtcaagaccgtcatcggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18519 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggcgccggcgtcaagaagcccggcgcctccgtccgcgtctcctgctggacctccgaggacatcttcaagaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18520 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccgacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18521 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcatctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18522 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18523 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggaccggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18524 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggccccacccaggacgacaccgccacctacttctgcgcccgccagaagttcgcccgcggcgaccagggctggttcttcgacctctggggccgcggcaccctcatcgtcgtctcctcc

SEQ ID NO: 18525 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18526 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18527 - RNA, 375 nt, synthetic construct
  misc_feature 1..375: note = derived and/or modified sequence opt2 from anti-HIV-1_HeavyChain
  source 1..375: mol_type = other RNA
cgccacacctggaacgagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18528 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18529 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18530 - RNA, 375 nt, synthetic construct
  misc_feature 1..375: note = derived and/or modified sequence opt2 from anti-HIV-1_HeavyChain
  source 1..375: mol_type = other RNA
caggcccacctcggcaccatcctcggcctcgagtccaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgcctccatcctcgcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18531 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgccctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18532 - RNA, 375 nt, synthetic construct
  misc_feature 1..375: note = derived and/or modified sequence opt2 from anti-HIV-1_HeavyChain
  source 1..375: mol_type = other RNA
cgcgtccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18533 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18534 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagcgccccggcgcctccgtcaaggtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18535 - RNA, 375 nt, synthetic construct
  misc_feature 1..375: note = derived and/or modified sequence opt2 from anti-HIV-1_HeavyChain
  source 1..375: mol_type = other RNA
cgccacgacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18536 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcaggtctggtccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18537 - RNA, 375 nt, synthetic construct
  misc_feature 1..375: note = derived and/or modified sequence opt2 from anti-HIV-1_HeavyChain
  source 1..375: mol_type = other RNA
cgccacacctggaacaagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18538 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18539 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18540 - RNA, 375 nt, synthetic construct
  misc_feature 1..375: note = derived and/or modified sequence opt2 from anti-HIV-1_HeavyChain
  source 1..375: mol_type = other RNA
cgccacgacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18541 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18542 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgcctcgcctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18543 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18544 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18545 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccacggcgacaccgccacctacttctgcgcccgccagaagttcgagcgcggcggccagggctggtacttcgacctctggggccgcggcaccctcatcgtcgtctcctcc

SEQ ID NO: 18546 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18547 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18548 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtcgaggtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 18549 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggcgccggcgtcaagaagctcggcgcctccgtccgcgtctcctgctggacctccgaggacatcttcaagaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18550 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18551 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcgcatctggtccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18552 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgccgcctcacccaggacgacaccgccacctacttctgcgcccgccagaagttcgcccgcggcgaccagggctggttcttcgacctctggggccgcggcaccctcatcgtcgtctcctcc

SEQ ID NO: 18553 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18554 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccccgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18555 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18556 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctgggcctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18557 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcaggtctggtccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18558 - RNA, 375 nt, synthetic construct
  misc_feature 1..375: note = derived and/or modified sequence opt2 from anti-HIV-1_HeavyChain
  source 1..375: mol_type = other RNA
cgccacacctggcgccagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgtcgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18559 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccggcgacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18560 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18561 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcgctgggcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18562 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18563 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcggcctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18564 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgccaacttcggctcctccgacttccgccagcgcgtctccctcacccccgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 18565 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggacctccgaggacatcttcgacaccaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18566 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctcccgcgacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18567 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgcctcgcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18568 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggccctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18569 - RNA, 375 nt, synthetic construct
  misc_feature 1..375: note = derived and/or modified sequence opt2 from anti-HIV-1_HeavyChain
  source 1..375: mol_type = other RNA
cgcgcccacctcgagcagtccggctccgagtggaagaagctcggcgcctccgtccgcgtctcctgctggacctccggcgacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18570 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggctccggcgtcaagaagctcggcgcctccgtcaacgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18571 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagcccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18572 - RNA, 375 nt, synthetic construct
  misc_feature 1..375: note = derived and/or modified sequence opt2 from anti-HIV-1_HeavyChain
  source 1..375: mol_type = other RNA
cgccacacctggaacaagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18573 - RNA, 375 nt, synthetic construct
  misc_feature 1..375: note = derived and/or modified sequence opt2 from anti-HIV-1_HeavyChain
  source 1..375: mol_type = other RNA
caggcccactccgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18574 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18575 - RNA, 375 nt, synthetic construct
  misc_feature 1..375: note = derived and/or modified sequence opt2 from anti-HIV-1_HeavyChain
  source 1..375: mol_type = other RNA
ggccacacctgggagcagtccggcgccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18576 - RNA, 375 nt, synthetic construct
  misc_feature 1..375: note = derived and/or modified sequence opt2 from anti-HIV-1_HeavyChain
  source 1..375: mol_type = other RNA
ggcacccccggctccgagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18577 - RNA, 375 nt, synthetic construct
  misc_feature 1..375: note = derived and/or modified sequence opt2 from anti-HIV-1_HeavyChain
  source 1..375: mol_type = other RNA
ggcacccccggctccgagtccggctccggcgtcaagatgcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18578 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18579 - RNA, 375 nt, synthetic construct
  misc_feature 1..375: note = derived and/or modified sequence opt2 from anti-HIV-1_HeavyChain
  source 1..375: mol_type = other RNA
ggcacccccggcaacaagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18580 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18581 - RNA, 375 nt, synthetic construct
  misc_feature 1..375: note = derived and/or modified sequence opt2 from anti-HIV-1_HeavyChain
  source 1..375: mol_type = other RNA
ggcacccccggcaacaagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18582 - RNA, 375 nt, synthetic construct
  misc_feature 1..375: note = derived and/or modified sequence opt2 from anti-HIV-1_HeavyChain
  source 1..375: mol_type = other RNA
ggcacccccggcaacaagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 18583 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtcaagcgccccggcggctgggtccgcgtctcctgctggacctccgaggacatcttcgagcgctccgagctcatctactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18584 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagacctcctccggcgccgtcaacttcggctcccccaacttccgcacccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18585 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18586 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18587 - RNA, 375 nt, synthetic construct
  misc_feature 1..375: note = derived and/or modified sequence opt2 from anti-HIV-1_HeavyChain
  source 1..375: mol_type = other RNA
ggcaccacctggaacaagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18588 - RNA, 375 nt, synthetic construct
  misc_feature 1..375: note = derived and/or modified sequence opt2 from anti-HIV-1_HeavyChain
  source 1..375: mol_type = other RNA
cgccacacctggaacgagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18589 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccggcaacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18590 - RNA, 378 nt, synthetic construct
  misc_feature 1..378: note = derived and/or modified sequence opt2 from anti-HIV-1_HeavyChain
  source 1..378: mol_type = other RNA
cgctgctccatggagcagcccggctggtccgagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18591 - RNA, 375 nt, synthetic construct
  misc_feature 1..375: note = derived and/or modified sequence opt2 from anti-HIV-1_HeavyChain
  source 1..375: mol_type = other RNA
cgccacacctccgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctcc

SEQ ID NO: 18592 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18593 - RNA, 375 nt, synthetic construct
  misc_feature 1..375: note = derived and/or modified sequence opt2 from anti-HIV-1_HeavyChain
  source 1..375: mol_type = other RNA
ggcaccccctggaacgagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18594 - RNA, 375 nt, synthetic construct
  misc_feature 1..375: note = derived and/or modified sequence opt2 from anti-HIV-1_HeavyChain
  source 1..375: mol_type = other RNA
cgccacgacctcgagccctccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtc

SEQ ID NO: 18595 - RNA, 375 nt, synthetic construct
  misc_feature 1..375: note = derived and/or modified sequence opt2 from anti-HIV-1_HeavyChain
  source 1..375: mol_type = other RNA
cgccacaccgtcgagcagtccggctccggcgtcaagaagctcggcgcctccgtccgcgtctcctgcctcgcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18596 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccgagtccaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18597 - RNA, 375 nt, synthetic construct
  misc_feature 1..375: note = derived and/or modified sequence opt2 from anti-HIV-1_HeavyChain
  source 1..375: mol_type = other RNA
ggcacccccggctccgagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcggctccgtcgacttccgcgaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18598 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagcccggcgcctccgtccgcgtctcctgctggacctccgaggacatcttcgagaagtccgagctcatccagtgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18599 - RNA, 375 nt, synthetic construct
  misc_feature 1..375: note = derived and/or modified sequence opt2 from anti-HIV-1_HeavyChain
  source 1..375: mol_type = other RNA
ggcacccccggctccgagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccgcatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18600 - RNA, 375 nt, synthetic construct
  misc_feature 1..375: note = derived and/or modified sequence opt2 from anti-HIV-1_HeavyChain
  source 1..375: mol_type = other RNA
ggcacccccggctccgagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18601 - RNA, 372 nt, synthetic construct
  misc_feature 1..372: note = derived and/or modified sequence opt2 from anti-HIV-1_HeavyChain
  source 1..372: mol_type = other RNA
cgcgcccacctcgagcagtccggcgccggcgtcaagaagcccggcggctgggtccgcgtctcctgctggacctccgaggacatcttcaagaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18602 - RNA, 378 nt, synthetic construct
  misc_feature 1..378: note = derived and/or modified sequence opt2 from anti-HIV-1_HeavyChain
  source 1..378: mol_type = other RNA
caggtccagctcatgcagtccggcgccgaggtcaagcgccccggcgcctccgtcaagatctcctgcaccgcctccggcttcaccctcaccgaccactacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18603 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgaggtcaagaagcccggcgcctccgtcaaggtctcctgcaaggcctccggctacaacttcaccggctactacctccactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18604 - RNA, 375 nt, synthetic construct
  misc_feature 1..375: note = derived and/or modified sequence opt2 from anti-HIV-1_HeavyChain
  source 1..375: mol_type = other RNA
ggcacccccggctccaagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18605 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgagctcaagaagcccggcgcctccgtcaaggtctcctgcgaggcctccggctactccttcaccgaccaccacatccactgggtccgccaggcccccggccagggcctcgagtggctcggctggatgaaccccaacaacggcgacaccgcctacgcccagaccttcctcggccgcgtcaccatgacccgcgacacctccatcaacaccgcctacatggagctctcccgcctcacctccgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18606 - RNA, 378 nt, synthetic construct
  misc_feature 1..378: note = derived and/or modified sequence opt2 from anti-HIV-1_HeavyChain
  source 1..378: mol_type = other RNA
caggtctacatgtcctcccgcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18607 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgaggtcaagaagcccggcgcctccgtcaaggtctcctgcaaggcctccggctacaccttcaccgcctactacatgcactggctccgccaggcccccggccagggcctcgagtggatgggctggatcaacccccactccggcggcaccaacttcgcccagaagttccagggccgcgtcaccatgacccgcgacacctccatcaccaccgcctacatggagctctcccgcctccgctccgacgacaccgccacctacttctgcgcccgccagaagttcgcctcccgctactccggcgaccagggctcctacttcgacctctggggccgcggcaccctcatcgtcgtctcctcc

SEQ ID NO: 18608 - RNA, 375 nt, synthetic construct
  misc_feature 1..375: note = derived and/or modified sequence opt2 from anti-HIV-1_HeavyChain
  source 1..375: mol_type = other RNA
cgcgcccacctcgagcagtccggcgccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 18609 - RNA, 378 nt, synthetic construct
  misc_feature 1..378: note = derived and/or modified sequence opt2 from anti-HIV-1_HeavyChain
  source 1..378: mol_type = other RNA
caggtccgcctcgtccagtccggcgccgacgtcaagcagcccggcgcctccgtcaaggtctcctgcaaggcctccggctacaccttcaccgactactacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18610 - RNA, 378 nt, synthetic construct
  misc_feature 1..378: note = derived and/or modified sequence opt2 from anti-HIV-1_HeavyChain
  source 1..378: mol_type = other RNA
caggcccacctcggcaacaagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 18611 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagtccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcacccgcaagaccgccggcgacgtctccggcgacaagcgcggcttcttcttcgacctctggggccgcggctcccgcgtcatcgtctcctcc

SEQ ID NO: 18612 - RNA, 381 nt, synthetic construct
  misc_feature 1..381: note = derived and/or modified sequence opt2 from anti-HIV-1_HeavyChain
  source 1..381: mol_type = other RNA
caggtctacgtcgagcagcccggcggcggcgtcaagaagcccggcgcctccgtcaccctctcctgcaagaccgccgacgaggacgtcttcgacgccacctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18613 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgtcgaggtcgagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18614 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18615 - RNA, 381 nt, synthetic construct
  misc_feature 1..381: note = derived and/or modified sequence opt2 from anti-HIV-1_HeavyChain
  source 1..381: mol_type = other RNA
caggtccacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18616 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccgaggtcaagaagcccggcgcctccgtcaccctctcctgcgagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18617 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagcccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18618 - RNA, 372 nt, synthetic construct
  misc_feature 1..372: note = derived and/or modified sequence opt2 from anti-HIV-1_HeavyChain
  source 1..372: mol_type = other RNA
gccaccccctggaacaagtccggctccggcgtcaagaagcccggcgcctccgtccgcgtctcctgctggacctccgaggacatcttcgagcgcaccgagctctccctcgtccgccaggcccccggccagggcctcgagtggatcggctggatgaagaccgtcaccggcgccgtcaacttcggctcccccaacttccgccacggcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18619 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcatgaagaagcccggcgcctccatgaccgcctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18620 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgaggtcaagaagcccggcgcctccgtcaaggtctcctgcaaggcctccggctacaccttcaccggctactacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaaggccgacgtctccggcgacgaccgcggcttcttcttcgacctctggggccgcggcacccgcgtcatcgtctcctcc

SEQ ID NO: 18621 - RNA, 381 nt, synthetic construct
  misc_feature 1..381: note = derived and/or modified sequence opt2 from anti-HIV-1_HeavyChain
  source 1..381: mol_type = other RNA
cgcgtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttcaccatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18622 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagtccggcggcggcgtcaagaagcccggcccctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18623 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgaggtcaagaagcccggcgcctccgtcaaggtctcctgcaaggcctccggctacaccttcaccggctactacatccactggatgcgccaggcccccggccagggcctcgagtggatgggctggatcaaccccaactccggcgccgtctcctacgcccgcaagttccagggccgcgtctccttcctccacgaccagggcatccgcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18624 - RNA, 381 nt, synthetic construct
  misc_feature 1..381: note = derived and/or modified sequence opt2 from anti-HIV-1_HeavyChain
  source 1..381: mol_type = other RNA
caggtccacatggagcaggccggcgtcgaggtcgagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18625 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcgtcaagaagcccggcgcctccgccaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18626 - RNA, 375 nt, synthetic construct
  misc_feature 1..375: note = derived and/or modified sequence opt2 from anti-HIV-1_HeavyChain
  source 1..375: mol_type = other RNA
ggccacgacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctcc

SEQ ID NO: 18627 - RNA, 378 nt, synthetic construct
  misc_feature 1..378: note = derived and/or modified sequence opt2 from anti-HIV-1_HeavyChain
  source 1..378: mol_type = other RNA
caggcccaccgcggcaccatctggggcctcgaggtcaagaagcccggcggctgggtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 18628 - RNA, 381 nt, synthetic construct
  misc_feature 1..381: note = derived and/or modified sequence opt2 from anti-HIV-1_HeavyChain
  source 1..381: mol_type = other RNA
caggtccacatggagcaggccggcgccggcgtcgagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18629 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagtccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18630 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagtccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18631 - RNA, 381 nt, synthetic construct
  misc_feature 1..381: note = derived and/or modified sequence opt2 from anti-HIV-1_HeavyChain
  source 1..381: mol_type = other RNA
gaggtctacatggagcagtccggcggcggcgtcaagaagcccggcgcctccgtcaccctctcctgcaagaccgcctccgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18632 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18633 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcagtccggcggcggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18634 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccgcttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18635 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcgtcaagaagcccggcgcctccgtcaccctctcctgcaaggccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18636 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcaggccggcgccggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18637 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagcccggcggcgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18638 - RNA, 381 nt, synthetic construct
  misc_feature 1..381: note = derived and/or modified sequence opt2 from anti-HIV-1_HeavyChain
  source 1..381: mol_type = other RNA
caggtccacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18639 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggcccccgcgtcatcgtctcctcc

SEQ ID NO: 18640 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaaggtctcctgcaaggcctccggccacaccttcaccaactacgacatcaactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18641 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacaccgacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18642 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18643 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggcccggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18644 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgccaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18645 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcgctgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18646 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaaggtctcctgccgcgcctccggctacaccttcggcaaccacgccatctcctgggtccgccaggcccccggccagggcctcgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18647 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccccggctcccgcgtcatcgtctcctcc

SEQ ID NO: 18648 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18649 - RNA, 381 nt, synthetic construct
  misc_feature 1..381: note = derived and/or modified sequence opt2 from anti-HIV-1_HeavyChain
  source 1..381: mol_type = other RNA
caggtccacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18650 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgacggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18651 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaccctctcctgcaagaccgccgacgaggacgtcttcgacgccgcctacatgcactgggtccgccaggcccagggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18652 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccaggtcatcgtctcctcc

SEQ ID NO: 18653 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtccgcaagcccggcgcctccgtcaaggtctcctgcaaggcctccggctacaccttcaccaactactacatgcactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18654 - RNA, 381 nt, synthetic construct
  misc_feature 1..381: note = derived and/or modified sequence opt2 from anti-HIV-1_HeavyChain
  source 1..381: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18655 - RNA, 381 nt, synthetic construct
  misc_feature 1..381: note = derived and/or modified sequence opt2 from anti-HIV-1_HeavyChain
  source 1..381: mol_type = other RNA
ctcatccacctcgcccagtccggcgccgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18656 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18657 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagggccgcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18658 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagtccgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18659 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggctcctccatcaaggtctcctgcaaggcctccggcgacaccatctcccgctacgccatcaactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatgggcatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18660 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacatcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18661 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaacttccagggccgcgtctccttctaccgcacccgcgagctcggcatcgcctacatggacctccgcaacctccgcttcgacgacaccgccgtctacttctgcgcccgccagaagttcgagtcccgctactccggcgaccagggctcctacttcgacctctggggccgcggcaccctcatcatcgtctcctcc

SEQ ID NO: 18662 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagcgccccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18663 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgacgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18664 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccggcgtcaagaagcccggctcctccgtcaaggtctcctgcaaggcctccggcggcaccttctcctcctacgccatcaactggctccgccaggtccccggccagcgccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18665 - RNA, 381 nt, synthetic construct
  misc_feature 1..381: note = derived and/or modified sequence opt2 from anti-HIV-1_HeavyChain
  source 1..381: mol_type = other RNA
caggtctacatggagcgcgccggcggcggcgtcaagaagcccggcgcctccgtcaccctctcctgcgagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18666 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttcctccaggaccagggcatccgcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18667 - RNA, 381 nt, synthetic construct
  misc_feature 1..381: note = derived and/or modified sequence opt2 from anti-HIV-1_HeavyChain
  source 1..381: mol_type = other RNA
caggtctacatgggcgccggccgcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18668 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagcccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18669 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaagatctcctgcaaggcctccggctacaccttcatccgccacggcatccactggctccgccaggtccccggccagcgccccgagtggatgggctggatccgccccaagaccggcgcccgcaaccaggcccgccagttccagccccgcatctccctcgcccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18670 - RNA, 381 nt, synthetic construct
  misc_feature 1..381: note = derived and/or modified sequence opt2 from anti-HIV-1_HeavyChain
  source 1..381: mol_type = other RNA
caggtcctcctcgtccagtccggcgccgaggtcaagaagcccggctcctccgtcaaggtctcctgcaaggcctccggcgactccctcaccaagtacgccttctcctgggtccgccaggcccccggccagggccccgagtggatgggctggatccgccccaagaccggcgcccgcaaccgcgcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18671 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccgcggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18672 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18673 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccccggctcccgcgtcatcgtctcctcc

SEQ ID NO: 18674 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacatcttcgacgccgcctacatgcgctgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18675 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacctcgacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18676 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaaggtctcctgcaaggcctccggctacaccttcaccggctactacatgcactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18677 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatcaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18678 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccgtcaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18679 - RNA, 381 nt, synthetic construct
  misc_feature 1..381: note = derived and/or modified sequence opt2 from anti-HIV-1_HeavyChain
  source 1..381: mol_type = other RNA
caggcccacctcgagcagtccggctccggcgtcaagaagcccggcgcctccgtccgcgtctcctgctggtcctccgaggacatctccaaggccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18680 - RNA, 381 nt, synthetic construct
  misc_feature 1..381: note = derived and/or modified sequence opt2 from anti-HIV-1_HeavyChain
  source 1..381: mol_type = other RNA
caggtctacatggaggccggccgcggcggcgtcaagaagcccggcgcctccgccaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18681 - RNA, 381 nt, synthetic construct
  misc_feature 1..381: note = derived and/or modified sequence opt2 from anti-HIV-1_HeavyChain
  source 1..381: mol_type = other RNA
cgctgcatctggcgccaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18682 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatcaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18683 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtcaagtcctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18684 - RNA, 381 nt, synthetic construct
  misc_feature 1..381: note = derived and/or modified sequence opt2 from anti-HIV-1_HeavyChain
  source 1..381: mol_type = other RNA
cgctgcctctggcgccaggccggcggcggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18685 - RNA, 381 nt, synthetic construct
  misc_feature 1..381: note = derived and/or modified sequence opt2 from anti-HIV-1_HeavyChain
  source 1..381: mol_type = other RNA
cgctgcatctgggagcgcgccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18686 - RNA, 381 nt, synthetic construct
  misc_feature 1..381: note = derived and/or modified sequence opt2 from anti-HIV-1_HeavyChain
  source 1..381: mol_type = other RNA
caggtccagctcgagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18687 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18688 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcgctgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18689 - RNA, 381 nt, synthetic construct
  misc_feature 1..381: note = derived and/or modified sequence opt2 from anti-HIV-1_HeavyChain
  source 1..381: mol_type = other RNA
caggtctacatggagcagcccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18690 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18691 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtccgcgtctcctgccaggcctccggctacatcttcaccggctacttcgtcaactggctccgccagctccccggccagcgccccgagtggatgggctggatccgccccaagtccggcgcccgcaaccaggcccgccagttccagccccgcatctccctcacccgcgaccgcgccctctccaccgcctacctcgactccaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18692 - RNA, 381 nt, synthetic construct
  misc_feature 1..381: note = derived and/or modified sequence opt2 from anti-HIV-1_HeavyChain
  source 1..381: mol_type = other RNA
ggctgcatctggacccaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18693 - RNA, 381 nt, synthetic construct
  misc_feature 1..381: note = derived and/or modified sequence opt2 from anti-HIV-1_HeavyChain
  source 1..381: mol_type = other RNA
cgctgcatctggcgccaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18694 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtgggtcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18695 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaaggagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 18696 - RNA, 381 nt, synthetic construct
  misc_feature 1..381: note = derived and/or modified sequence opt2 from anti-HIV-1_HeavyChain
  source 1..381: mol_type = other RNA
caggcccacctcgagcagtccggctccggcgtcaagaagcccggcgcctccgtccgcgtctcctgctggtcctccgaggacatcttcaagaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18697 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctggatgaagaccgtcaccggcgccgtcaacttcggctccctcgacttccgccaccgcatctccctcacccgcgaccgcgacctcttcaccgcccacatggacatccgcggcctcgcccagggcgacaccgccacctacttctgcgcccgccagaagttcgagtcccgctacaccggcggccagggctggtacttcgacctctggggccgcggcacccacatcgtcgtctcctcc

SEQ ID NO: 18698 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18699 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18700 - RNA, 384 nt, synthetic construct
  misc_feature 1..384: note = derived and/or modified sequence opt2 from anti-HIV-1_HeavyChain
  source 1..384: mol_type = other RNA
tcccacacctggaacaaccgcggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18701 - RNA, 381 nt, synthetic construct
  misc_feature 1..381: note = derived and/or modified sequence opt2 from anti-HIV-1_HeavyChain
  source 1..381: mol_type = other RNA
cagtcccacctcgagcagtccggctccgccatgaagaagcccggcgcctccgtccgcgtctcctgctggacctccgaggacatcttccacaacgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18702 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctggatgaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18703 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcaggccggcggcgaggtcaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18704 - RNA, 381 nt, synthetic construct
  misc_feature 1..381: note = derived and/or modified sequence opt2 from anti-HIV-1_HeavyChain
  source 1..381: mol_type = other RNA
caggcccacctcgagcagtccggctccggcgtcaagaagctcggcgcctccgtccgcgtctcctgctggacctccgaggacatcttcgaggacgagctcatccactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18705 - RNA, 381 nt, synthetic construct
  misc_feature 1..381: note = derived and/or modified sequence opt2 from anti-HIV-1_HeavyChain
  source 1..381: mol_type = other RNA
cagtcccacctcgagcagtccggctccgccatgaagaagcccggcgcctccgtccgcgtctcctgctggacctccgaggacatcctcaaggccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18706 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaaggtctcctgcaaggcctccggctactccttcaccgactactacatccactggctccgccaggtccagggccagcgccccgagtggatgggctggatccgcccccgcaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18707 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcaggccggcggcgaggtcaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 18708 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18709 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggcgccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18710 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctgggcctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18711 - RNA, 381 nt, synthetic construct
  misc_feature 1..381: note = derived and/or modified sequence opt2 from anti-HIV-1_HeavyChain
  source 1..381: mol_type = other RNA
cgctgccgcctcgtccagtccggcgccgaggtcaagaagcccggcgcctccgtccgcgtctcctgccaggcctccggctacaccttctccgcctacggcgtcaactgggtccgccaggcccccggccaggagctcgagtggatcggctgggtcaagaccgtcaccggcgccgtcaacttcggctcccccaacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18712 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtctgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18713 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagatcgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18714 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccggcctcgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18715 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctcc

SEQ ID NO: 18716 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgcctcccgctactccggcgaccagggctcctacttcgacctctggggccgcggcaccctcatcgtcgtctcctcc

SEQ ID NO: 18717 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18718 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18719 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgagtcccgctacaccggcggccagggctggtacttcgacctctggggccgcggcacccacatcgtcgtctcctcc

SEQ ID NO: 18720 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccggcgccgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctcc

SEQ ID NO: 18721 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18722 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccgacttccgccaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18723 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccgcggcctcgagtggatcggctgggtcaagaccgtctccggcaccgtcaacttcggctcctccgacttccgcaaccgcgtctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18724 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18725 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagcgccccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18726 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18727 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacttcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18728 - RNA, 381 nt, synthetic construct
  misc_feature 1..381: note = derived and/or modified sequence opt2 from anti-HIV-1_HeavyChain
  source 1..381: mol_type = other RNA
caggcccacctcgagcagtccggctccggcgtcaagaagcccggcgcctccgtccgcgtctcctgctggtcctccgaggacatcttccgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18729 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctcc

SEQ ID NO: 18730 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18731 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18732 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18733 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18734 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcggcaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18735 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18736 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgagggcatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18737 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggcccgccaggcccccggccagggcctcgagtggatcggctgggtcaagaccgtcaccggcgccgtcaacttcggctcccccaacttccgccaccgcgcctccctcacccgcgaccgcgacctcttcaccgcccacatggacatccgcggcctcaccgagggcgacaccgccacctacttctgcgcccgccagaagttcgcctcccgctactccggcgaccagggctcctacttcgacctctggggccgcggcaccctcatcatcgtctcctcc

SEQ ID NO: 18738 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccgccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctcc

SEQ ID NO: 18739 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcgagtgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctcc

SEQ ID NO: 18740 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcgactgcgtctcctcc

SEQ ID NO: 18741 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcgccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18742 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18743 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18744 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18745 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18746 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18747 - RNA, 384 nt, synthetic construct
  misc_feature 1..384: note = derived and/or modified sequence opt2 from anti-HIV-1_HeavyChain
  source 1..384: mol_type = other RNA
caggcccgcctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18748 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18749 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18750 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgccaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18751 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18752 - RNA, 381 nt, synthetic construct
  misc_feature 1..381: note = derived and/or modified sequence opt2 from anti-HIV-1_HeavyChain
  source 1..381: mol_type = other RNA
cgctgcatctggcgccaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcggcatccgcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 18753 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18754 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18755 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccgccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18756 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgcctcccgctactccggcgaccagggctcctacttcgacctctggggccgcggcaccctcatcgtcgtctcctcc

SEQ ID NO: 18757 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcacccgccagaagttcgagtcccgctacaccggcggccagggctggtacttcgacctctggggccgcggcacccacatcgtcgtctcctcc

SEQ ID NO: 18758 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggccccgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18759 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggccccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18760 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggccccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18761 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcggcctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18762 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcctcccgctactccggcgaccagggctcctacttcgacctctggggccgcggcaccctcatcatcgtctcctcc

SEQ ID NO: 18763 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcactccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18764 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctcc

SEQ ID NO: 18765 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18766 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcggctccgtcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctcc

SEQ ID NO: 18767 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtcaagcgccccggcgcctccgtccgcgtctcctgctggacctccgaggacatcttcgagcgcaccgagctcatctactgggtccgccaggcccccggccagggcctcgagtggatcggctgggtcaagaccgtctccggcgccgtcaacttcggctcccaggacttccgcgaccgcttctccctcacccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18768 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18769 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18770 - RNA, 384 nt, synthetic construct
  misc_feature 1..384: note = derived and/or modified sequence opt2 from anti-HIV-1_HeavyChain
  source 1..384: mol_type = other RNA
cagtcccacctcaagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18771 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18772 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctcc

SEQ ID NO: 18773 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18774 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcctcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18775 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgcctcccgctactccggcgaccagggctcctacttcgacctctggggccgcggcaccctcatcgtcgtctcctcc

SEQ ID NO: 18776 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18777 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgacgacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18778 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18779 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18780 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtcaagcgccccggcgcctccgtccgcgtctcctgctggacctccgaggacatcttcgagcgcaccgagctcatctactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18781 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcggctccgtcgacttccgcgaccgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18782 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18783 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18784 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctcccccacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcaccctcatcgtcgtctcctcc

SEQ ID NO: 18785 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctccccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18786 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgcctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18787 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18788 - RNA, 384 nt, synthetic construct
  misc_feature 1..384: note = derived and/or modified sequence opt2 from anti-HIV-1_HeavyChain
  source 1..384: mol_type = other RNA
caggtccagctcgtccagtccggcgccgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctcc

SEQ ID NO: 18789 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18790 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18791 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctcc

SEQ ID NO: 18792 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcgtcgtctcctcc

SEQ ID NO: 18793 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18794 - RNA, 381 nt, synthetic construct
  misc_feature 1..381: note = derived and/or modified sequence opt2 from anti-HIV-1_HeavyChain
  source 1..381: mol_type = other RNA
caggcccacctcgagcagtccggctccggcgtcaagaagcccggcgcctccgtccgcgtctcctgctggacctccgaggacatcctccgcaagtccgagctcatccactgggtccgccaggcccccggccagggcctcgagtggatcggctgggtcaagaccgtcaccggcgccgtcaacttcggccaccagatctccgaccgcgtctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18795 - RNA, 384 nt, synthetic construct
  misc_feature 1..384: note = derived and/or modified sequence opt2 from anti-HIV-1_HeavyChain
  source 1..384: mol_type = other RNA
cccgcccacctcgagcagtccggctccggcgtcaagaagcccggcgcctccgtccgcgtctcctgctgggcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18796 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggatcggctgggtcaagaccgtctccggcgccgtcaacttcggctccaccgacttccgcgagcgcatctccctctcccgcgaccgcgacctctccaccgcctacatggacatccgcggcctcacccaggacgacgccgccacctacttctgcgcccgccagaagttcgcctcccgctactccggcgaccagggctcctacttcgacctctggggccgcggcaccctcatcgtcgtctcctcc

SEQ ID NO: 18797 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacctccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18798 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcaccctcatcgtcgtctcctcc

SEQ ID NO: 18799 - RNA, 384 nt, synthetic construct
  misc_feature 1..384: note = derived and/or modified sequence opt2 from anti-HIV-1_HeavyChain
  source 1..384: mol_type = other RNA
tcccacgacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18800 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18801 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcctcccgctactccggcgaccagggctcctacttcgacctctggggccgcggcaccctcatcgtcgtctcctcc

SEQ ID NO: 18802 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgcaaccgcatctccctctcccgcgaccgcgacctctccaccgcccacatgggcatccgcggcctccgccaggacgacaccgccacctacttctgcgcccgccagaagttcgagtcccgctactccggcgaccagggctcctacttcgacctctggggccgcggcaccctcatcatcgtctcctcc

SEQ ID NO: 18803 - RNA, 384 nt, synthetic construct
  misc_feature 1..384: note = derived and/or modified sequence opt2 from anti-HIV-1_HeavyChain
  source 1..384: mol_type = other RNA
gaggtccagctcgtccagtccggcgccgacgtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18804 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccaccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18805 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgccctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18806 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18807 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18808 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18809 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcggctggatcggctgggtcaagatcgtctccggcaccgtcaacttcgcctccctcgacttccgctcccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18810 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggccaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18811 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18812 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18813 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18814 - RNA, 384 nt, synthetic construct
  misc_feature 1..384: note = derived and/or modified sequence opt2 from anti-HIV-1_HeavyChain
  source 1..384: mol_type = other RNA
tcccacaacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18815 - RNA, 384 nt, synthetic construct
  misc_feature 1..384: note = derived and/or modified sequence opt2 from anti-HIV-1_HeavyChain
  source 1..384: mol_type = other RNA
tcccacacctggaacaaccgcggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18816 - RNA, 384 nt, synthetic construct
  misc_feature 1..384: note = derived and/or modified sequence opt2 from anti-HIV-1_HeavyChain
  source 1..384: mol_type = other RNA
tcccacacctggaacgagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18817 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaactacggctccctcaacttccgctcccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18818 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtcaaggtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18819 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18820 - RNA, 384 nt, synthetic construct
  misc_feature 1..384: note = derived and/or modified sequence opt2 from anti-HIV-1_HeavyChain
  source 1..384: mol_type = other RNA
ggccacgacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18821 - RNA, 384 nt, synthetic construct
  misc_feature 1..384: note = derived and/or modified sequence opt2 from anti-HIV-1_HeavyChain
  source 1..384: mol_type = other RNA
tcccacacctggaacaaccgcggctccgccatgaagaagcccggcgcctccgtccgcgtctcctgctggacctccgaggacatcttcgacaccaccgagctcatctactgggtccgccaggcccccggccagggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18822 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18823 - RNA, 384 nt, synthetic construct
  misc_feature 1..384: note = derived and/or modified sequence opt2 from anti-HIV-1_HeavyChain
  source 1..384: mol_type = other RNA
tcccacacctggaacaaccgcggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18824 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgcctcgcctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18825 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggcgccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctcc

SEQ ID NO: 18826 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18827 - RNA, 384 nt, synthetic construct
  misc_feature 1..384: note = derived and/or modified sequence opt2 from anti-HIV-1_HeavyChain
  source 1..384: mol_type = other RNA
tcccacacctggaacgagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18828 - RNA, 384 nt, synthetic construct
  misc_feature 1..384: note = derived and/or modified sequence opt2 from anti-HIV-1_HeavyChain
  source 1..384: mol_type = other RNA
cgccacacctggaacgagtccggctccggcgtcaagaagcccggcgcctccgtccgcgtctcctgctggtcctccgaggacatcttcgagcgcaccgagctcatccactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18829 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgagatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18830 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctcc

SEQ ID NO: 18831 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccagatcttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18832 - RNA, 384 nt, synthetic construct
  misc_feature 1..384: note = derived and/or modified sequence opt2 from anti-HIV-1_HeavyChain
  source 1..384: mol_type = other RNA
tcccacacctggaacaagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18833 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctcccagatcttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggccccaccctcttcgtctcctcc

SEQ ID NO: 18834 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagacctgctccggcgccgtcaacttcggctccgtcgacttccgcgaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18835 - RNA, 384 nt, synthetic construct
  misc_feature 1..384: note = derived and/or modified sequence opt2 from anti-HIV-1_HeavyChain
  source 1..384: mol_type = other RNA
tcccacaccgtcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18836 - RNA, 384 nt, synthetic construct
  misc_feature 1..384: note = derived and/or modified sequence opt2 from anti-HIV-1_HeavyChain
  source 1..384: mol_type = other RNA
cgccacacctggaacaagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18837 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagcgcctcgagtggatcggctgggtcaagaccgtcaccggcgccgtcaacttcggctcccccaacttccgccaccgcgtctccctcacccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18838 - RNA, 384 nt, synthetic construct
  misc_feature 1..384: note = derived and/or modified sequence opt2 from anti-HIV-1_HeavyChain
  source 1..384: mol_type = other RNA
tcccacgacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctcc

SEQ ID NO: 18839 - RNA, 384 nt, synthetic construct
  misc_feature 1..384: note = derived and/or modified sequence opt2 from anti-HIV-1_HeavyChain
  source 1..384: mol_type = other RNA
cgccacacctggaacgagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccaccacctacttctgcgcccgccagaagttcgagtcccgctacaccggcggccagggctggtacttcgacctctggggccgcggcacccacatcgtcgtctcctcc

SEQ ID NO: 18840 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcaggtctggtccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18841 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtcaccgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18842 - RNA, 384 nt, synthetic construct
  misc_feature 1..384: note = derived and/or modified sequence opt2 from anti-HIV-1_HeavyChain
  source 1..384: mol_type = other RNA
cgccacgacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18843 - RNA, 384 nt, synthetic construct
  misc_feature 1..384: note = derived and/or modified sequence opt2 from anti-HIV-1_HeavyChain
  source 1..384: mol_type = other RNA
gtcaccacctggaacaagtccggctccgccatgaagaagcccggcgcctccgtccgcgtctcctgctggacctccgaggacatcttcgacaccaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18844 - RNA, 384 nt, synthetic construct
  misc_feature 1..384: note = derived and/or modified sequence opt2 from anti-HIV-1_HeavyChain
  source 1..384: mol_type = other RNA
cgccacacctggaacaacaccggctccggcgtcaagaagcccggcgcctccgtccgcgtctcctgcctcgcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18845 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgcctcgcctccgaggacatcttcgagcgcaccgagctcatctactgggtccgccaggcccccggccgcggccccgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18846 - RNA, 384 nt, synthetic construct
  misc_feature 1..384: note = derived and/or modified sequence opt2 from anti-HIV-1_HeavyChain
  source 1..384: mol_type = other RNA
cgccacacctggaacaacaccggctccggcgtcaagaagcccggcgcctccgtccgcgtctcctgctggacctccgacgacatcttcgagcgcaccgagctcatccactgggtccgccaggcccccggccagggcctcgagtggatcggctgggtcaagaccgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18847 - RNA, 384 nt, synthetic construct
  misc_feature 1..384: note = derived and/or modified sequence opt2 from anti-HIV-1_HeavyChain
  source 1..384: mol_type = other RNA
ggcacccccggcaacaagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18848 - RNA, 384 nt, synthetic construct
  misc_feature 1..384: note = derived and/or modified sequence opt2 from anti-HIV-1_HeavyChain
  source 1..384: mol_type = other RNA
ggcacccccggctccgagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18849 - RNA, 384 nt, synthetic construct
  misc_feature 1..384: note = derived and/or modified sequence opt2 from anti-HIV-1_HeavyChain
  source 1..384: mol_type = other RNA
gtcacccccggcaccaacctcggcctccgcatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18850 - RNA, 384 nt, synthetic construct
  misc_feature 1..384: note = derived and/or modified sequence opt2 from anti-HIV-1_HeavyChain
  source 1..384: mol_type = other RNA
cgccacgacctcgagcagtccggcgccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18851 - RNA, 384 nt, synthetic construct
  misc_feature 1..384: note = derived and/or modified sequence opt2 from anti-HIV-1_HeavyChain
  source 1..384: mol_type = other RNA
caggtccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccccgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18852 - RNA, 384 nt, synthetic construct
  misc_feature 1..384: note = derived and/or modified sequence opt2 from anti-HIV-1_HeavyChain
  source 1..384: mol_type = other RNA
ggcaccacctgggagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18853 - RNA, 384 nt, synthetic construct
  misc_feature 1..384: note = derived and/or modified sequence opt2 from anti-HIV-1_HeavyChain
  source 1..384: mol_type = other RNA
tcccacgacctcgagcagtccggctccgagtggaagaagcccggcgcctccgtccgcgtctcctgctggacctccgaggacatcttcgacaccaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18854 - RNA, 384 nt, synthetic construct
  misc_feature 1..384: note = derived and/or modified sequence opt2 from anti-HIV-1_HeavyChain
  source 1..384: mol_type = other RNA
cagtcccgccccggcaacaagtccggctccgccatgaagaagcccggcgcctccgtccgcgtctcctgctggacctccgaggacatcttcgagcgcaccgagctcctctgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctcc

SEQ ID NO: 18855 - RNA, 384 nt, synthetic construct
  misc_feature 1..384: note = derived and/or modified sequence opt2 from anti-HIV-1_HeavyChain
  source 1..384: mol_type = other RNA
ggcaccacctggtccaagtccggctccggcgtcaagaagcccggcgcctccgtccgcgtctcctgctggacctccgaggacatcttcgagcgcaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18856 - RNA, 387 nt, synthetic construct
  misc_feature 1..387: note = derived and/or modified sequence opt2 from anti-HIV-1_HeavyChain
  source 1..387: mol_type = other RNA
caggcccacctcgagcagtccggctccggcgtcaagaagcccggcgcctccgtccgcgtctcctgctggacctccgaggacatcctccgcaagaagcgcgtcgactccgtcggctgcgacaccgcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18857 - RNA, 387 nt, synthetic construct
  misc_feature 1..387: note = derived and/or modified sequence opt2 from anti-HIV-1_HeavyChain
  source 1..387: mol_type = other RNA
aaggcccacctcggcaacaagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18858 - RNA, 384 nt, synthetic construct
  misc_feature 1..384: note = derived and/or modified sequence opt2 from anti-HIV-1_HeavyChain
  source 1..384: mol_type = other RNA
accaccgtcggcaccatcctcggccgcgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18859 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtcaaggtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18860 - RNA, 387 nt, synthetic construct
  misc_feature 1..387: note = derived and/or modified sequence opt2 from anti-HIV-1_HeavyChain
  source 1..387: mol_type = other RNA
cagtcccacctcgagcaggtctgggtctgccagtccaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18861 - RNA, 384 nt, synthetic construct
  misc_feature 1..384: note = derived and/or modified sequence opt2 from anti-HIV-1_HeavyChain
  source 1..384: mol_type = other RNA
cgccacaccgtcgagcagtccggctccggcgtcaagaagcccggcgcctccgtccgcgtctcctgctggtcctccgaggacatcttcgagcgcaccgagctcatccactgggtccgccaggcccccggccagggcctcgagtggatgggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18862 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctccgcccgcgaggacatcttcgacaccaccgagctcatctactgggtccgccaggcccccggccagggcctcgagtggatcggctgggtcaagatcgtctgcggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 18863 - RNA, 387 nt, synthetic construct
  misc_feature 1..387: note = derived and/or modified sequence opt2 from anti-HIV-1_HeavyChain
  source 1..387: mol_type = other RNA
gaggtccagcgcggcggccgcgtcgtcggccgcgacgtcaagaagcccggcgcctccgtccgcgtctcctgctggacctccgaggacatcttccacaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18864 - RNA, 384 nt, synthetic construct
  misc_feature 1..384: note = derived and/or modified sequence opt2 from anti-HIV-1_HeavyChain
  source 1..384: mol_type = other RNA
ggcaccacctggaacgagtccggctccggcgtcaagaagcccggcgcctccgtccgcgtcccctgctggtcctccgaggacatcttcgagcgcaccgagctcatccaccgcgtccgccaggcccccggccagggcctcgagtggatcggctgggtcaagaccgtcaccggcgccgtcaacttcggctcccccaacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18865 - RNA, 384 nt, synthetic construct
  misc_feature 1..384: note = derived and/or modified sequence opt2 from anti-HIV-1_HeavyChain
  source 1..384: mol_type = other RNA
cgctccaactgggtccagtccggcgccgacgtcaagaagcccggcgcctccgtcaagtcctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 18866 - RNA, 384 nt, synthetic construct
  misc_feature 1..384: note = derived and/or modified sequence opt2 from anti-HIV-1_HeavyChain
  source 1..384: mol_type = other RNA
cccgtccagctcgtccagtccggcgccgaggtcaagaagcccggcgcctccgtcaaggtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 18867 - RNA, 399 nt, synthetic construct
  misc_feature 1..399: note = derived and/or modified sequence opt2 from anti-HIV-1_HeavyChain
  source 1..399: mol_type = other RNA
cgcgagtacctcgagcagtccggcggcggcgtcaagaagctcggcgcctccgtccgcgtctcctgccgcgcctccgaggacctcttcggcgacgaggccatctacgacgacgagctcatccactggctccgccaggtccccggccagcgccccgagtggatgggctggatccgccccaagaccggcgcccgcaaccaggcccgccagttccagccccgcatcaacctctcccgcgaccgcgccctcaacaccgcctacctcgacctctcctccctcacctccgccgactccgccacctacttctgcgcccgccagaccttcaagcccgacttctacttcgccgaccagggctggtccttcaacctctggggccgcggcgcccgcgtcatcgtctcctcc

SEQ ID NO: 18868 - RNA, 399 nt, synthetic construct
  misc_feature 1..399: note = derived and/or modified sequence opt2 from anti-HIV-1_HeavyChain
  source 1..399: mol_type = other RNA
caggtccagctcgtccagtccggcaccgaggtcaagaagcccggcgcctccctccgcgtctcctgccgcgcctccgaggacctcttcggcgacaagatcatctacgacgacgaggtcatccactggctccgccagctccccggccagcgccccgagtggatgggctggatccgccccaagtccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18869 - RNA, 399 nt, synthetic construct
  misc_feature 1..399: note = derived and/or modified sequence opt2 from anti-HIV-1_HeavyChain
  source 1..399: mol_type = other RNA
caggcccacctcgagcagtccggctccggcgtcaagaagcccggcgcctccgtccgcgtctcctgccgcgcctccgaggacctcttcggcgacgagatcatctacgacgacgaggtcatccactggctccgccaggtccccggccagcgccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18870 - RNA, 399 nt, synthetic construct
  misc_feature 1..399: note = derived and/or modified sequence opt2 from anti-HIV-1_HeavyChain
  source 1..399: mol_type = other RNA
ggcaacatctggtccgagtccggcggcggcgtcaagaagcccggcgcctccgtccgcgtctcctgccgcgcctccgaggacctcttcggcgacgagatcatctacgacgacgaggtcatccactggctccgccaggtccccggccagcgccccgagtggatgggctggatccgccccaagaacggcggccgcaaccaggcccgccagttccagccccgcatctccctcacccgcgaccgcgccctcaacaccgcctacctcgacctcaactccctcacctccgccgactccggcacctacttctgcgcccgccagaccttcaagcccgacttctacttcgccgaccagggctggtccttcaacctctggggccgcggcgcccgcgtcatcgtctcctcc

SEQ ID NO: 18871 - RNA, 399 nt, synthetic construct
  misc_feature 1..399: note = derived and/or modified sequence opt2 from anti-HIV-1_HeavyChain
  source 1..399: mol_type = other RNA
caggtccagctcgtccagtccggcgccgaggtcaagaagcccggcgcctccctccgcgtcccctgccgcgcctccgaggacctcttcggcgacgagatcatctacgacgacgaggtcatccactggctccgccaggtccccggccagcgccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 18872 - RNA, 390 nt, synthetic construct
  misc_feature 1..390: note = derived and/or modified sequence opt2 from anti-HIV-1_HeavyChain
  source 1..390: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctcccgctccgcc

SEQ ID NO: 18873 - RNA, 393 nt, synthetic construct
  misc_feature 1..393: note = derived and/or modified sequence opt2 from anti-HIV-1_HeavyChain
  source 1..393: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccacccgctccacc

SEQ ID NO: 18874 - RNA, 414 nt, synthetic construct
  misc_feature 1..414: note = derived and/or modified sequence opt2 from anti-HIV-1_HeavyChain
  source 1..414: mol_type = other RNA
caggtccagctcgtccagtccggcgccgaggtcaagaagcccggcgcctccgtcaccgtctcctgcaaggcctcccgctacaccttcatcaactactacatccactgggtccgccaggcccccggccagggcctcgagtggatcggctgggtcaagcccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18875 - RNA, 414 nt, synthetic construct
  misc_feature 1..414: note = derived and/or modified sequence opt2 from anti-HIV-1_HeavyChain
  source 1..414: mol_type = other RNA
caggtccagctcgtccagtccggcgccgaggtcaagaagcccggcgcctccgtcaaggtctcctgcaaggcctccggctacaccatcacccgccactacatgcactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18876 - RNA, 408 nt, synthetic construct
  misc_feature 1..408: note = derived and/or modified sequence opt2 from anti-HIV-1_HeavyChain
  source 1..408: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcctccaccaagggcccctccgacgacctccgc

SEQ ID NO: 18877 - RNA, 411 nt, synthetic construct
  misc_feature 1..411: note = derived and/or modified sequence opt2 from anti-HIV-1_HeavyChain
  source 1..411: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtctacgacctccgc

SEQ ID NO: 18878 - RNA, 417 nt, synthetic construct
  misc_feature 1..417: note = derived and/or modified sequence opt2 from anti-HIV-1_HeavyChain
  source 1..417: mol_type = other RNA
caggtccagctcgtccagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18879 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttccccaccatctacgtc

SEQ ID NO: 18880 - RNA, 417 nt, synthetic construct
  misc_feature 1..417: note = derived and/or modified sequence opt2 from anti-HIV-1_HeavyChain
  source 1..417: mol_type = other RNA
caggtccagctcgagcagtccggctccggcgtcaagaagctcggcgcctccgtccgcgtctcctgctggacctccgaggacatcttcgaggacgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccggcctccaccagggccccatcggcctccccccccgcctctcccgc

SEQ ID NO: 18881 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccccccgcgcccaccgctcctcccccaccatctgcgtc

SEQ ID NO: 18882 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18883 - RNA, 414 nt, synthetic construct
  misc_feature 1..414: note = derived and/or modified sequence opt2 from anti-HIV-1_HeavyChain
  source 1..414: mol_type = other RNA
caggtccacctcgtccagtccggcgccgaggtcaagcgccccggcgcctccgtcaaggtctcctgcaaggcctccggctacaccttcaccgactacttcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18884 - RNA, 420 nt, synthetic construct
  misc_feature 1..420: note = derived and/or modified sequence opt2 from anti-HIV-1_HeavyChain
  source 1..420: mol_type = other RNA
caggtccagctcgtccagtccggcgccgaggtcaagaagcccggcgcctccgtcaaggtctcctgcaaggcctccggctacatcttcaccggctcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttcccccacgacctccgc

SEQ ID NO: 18885 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18886 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18887 - RNA, 420 nt, synthetic construct
  misc_feature 1..420: note = derived and/or modified sequence opt2 from anti-HIV-1_HeavyChain
  source 1..420: mol_type = other RNA
caggtccagctcgtccagtccggcgccgaggtcaagaagcccggcgcctccgtcaaggtctcctgcaaggcctccggctacaccttcaccggctactacatccactgggtccgccaggcccccggccagggcctcgagtggatgggctggatcaaccccaactccggcgccaccaactacgcccagaagttccagggccgcctcaccatcgcccgcgacacctccatctccaccgcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcccccacgacctccgc

SEQ ID NO: 18888 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccacgacctccgc

SEQ ID NO: 18889 - RNA, 414 nt, synthetic construct
  misc_feature 1..414: note = derived and/or modified sequence opt2 from anti-HIV-1_HeavyChain
  source 1..414: mol_type = other RNA
caggccaccctcgagcagtccggctccggcgtcaagaagcccggcgcctccgtccgcgtctcctgctggtcctccgaggacatcttcaagaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacccacttctgcgcccgccagaagttcgcccgcggcgaccagggctggttcttcgacctctggggccgcggcaccctcatcgtcgtctcctccgcctccaccaagggcccctccgtcttccccaccatctacgtc

SEQ ID NO: 18890 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttccccaccatctgcgtc

SEQ ID NO: 18891 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccccccgcgcccaccgctcctccccccgctccgcc

SEQ ID NO: 18892 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttccccaccatctgcgtc

SEQ ID NO: 18893 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggccccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctccgcctccaccaaggcccaccgctcctccccccgctccacc

SEQ ID NO: 18894 - RNA, 420 nt, synthetic construct
  misc_feature 1..420: note = derived and/or modified sequence opt2 from anti-HIV-1_HeavyChain
  source 1..420: mol_type = other RNA
caggtccagctcgtccagtccggcgccgagatgaagaagcccggcgcctccgtcaagctctcctgcatgacctccggctacgtcttcaccgacttctacatccactgggtccgccaggcccccggccagggcctcgagtggatgggctggatcaaccccggcaccggcggcaccatctccgccccccgcttcctcggccgcgtcaccctcacccgcgacacctccatctccgccgcctacatcgagatcaaccgcgtcaccatcgacgacaccgccacctacttctgcgcccgccagaagttcgcctcccgctactccggcgaccagggctcctacttcgacctctggggccgcggcaccctcatcgtcgtctcctccgcctccaccaagggccccctcggcctccccccccgctccgcc

SEQ ID NO: 18895 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacccccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccccccgcgcccaccgctcctccccccgctccgcc

SEQ ID NO: 18896 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagcccgtcaccggcgccgtcaacctcgcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18897 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18898 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaaggcccaccgctcctccccccgctccacc

SEQ ID NO: 18899 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctgcgtc

SEQ ID NO: 18900 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagctcggcgcctccgtccgcgtctcctgctggacctccgaggacatcttcaagaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18901 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctacgtc

SEQ ID NO: 18902 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctgcgtc

SEQ ID NO: 18903 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccagatctacgtc

SEQ ID NO: 18904 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccagacccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctacgtc

SEQ ID NO: 18905 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatgggcatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttccccaccatctacgtc

SEQ ID NO: 18906 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18907 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccgctccgccgtc

SEQ ID NO: 18908 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctggatgaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18909 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatctccgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttccccaccatctgcgtc

SEQ ID NO: 18910 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18911 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttccccaccatctacgtc

SEQ ID NO: 18912 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctgcgtc

SEQ ID NO: 18913 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacctcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18914 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgagcgcggcggccagggctggatcttcgacctctggggccgcggcaccctcatcgccgtctcctccgcctccaccaagggcccctccgtcttccccaccatctgcgtc

SEQ ID NO: 18915 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctcgtc

SEQ ID NO: 18916 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctacgtc

SEQ ID NO: 18917 - RNA, 420 nt, synthetic construct
  misc_feature 1..420: note = derived and/or modified sequence opt2 from anti-HIV-1_HeavyChain
  source 1..420: mol_type = other RNA
caggtccacctcgagcagtccggctccggcgtcaagaagcccggcgcccccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaaggcccactccgtcctccccccccgctcccgcgtc

SEQ ID NO: 18918 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgccctcgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18919 - RNA, 414 nt, synthetic construct
  misc_feature 1..414: note = derived and/or modified sequence opt2 from anti-HIV-1_HeavyChain
  source 1..414: mol_type = other RNA
caggtccagctcgtccagtccggcgccgaggtcaagaagcccggcgcctccgtcaaggtctcctgccaggtctccggctacaccctcaccgagctctccatgcactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18920 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcaagaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18921 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctgcgtc

SEQ ID NO: 18922 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtgggtcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18923 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttccccaccatctgcgtc

SEQ ID NO: 18924 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccagatctgcgtc

SEQ ID NO: 18925 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggccaccagatctccgaccgcgtctccctcacccccgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctgcgtc

SEQ ID NO: 18926 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccgcgcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaaggcccaccgctcctcccccaccatctgcgtc

SEQ ID NO: 18927 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcccccaccaagggcccctccgtcttccccaccatctgcgtc

SEQ ID NO: 18928 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccagatctacgtc

SEQ ID NO: 18929 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcggccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctgcgtc

SEQ ID NO: 18930 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgaccacgtc

SEQ ID NO: 18931 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccagatctgcgtc

SEQ ID NO: 18932 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgtcgtctcctccgcctccaccaagggcccctccgtcttccccaccatctgcgtc

SEQ ID NO: 18933 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctgggcctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctcctc

SEQ ID NO: 18934 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18935 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18936 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcctccaccaagggcccctccgtcttccccaccatctgccgc

SEQ ID NO: 18937 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18938 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctacgtc

SEQ ID NO: 18939 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttcccccacgacctccgc

SEQ ID NO: 18940 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18941 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggccctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18942 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18943 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcgagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcctccaccaagggcccctccgtcttcccccacgacctccgc

SEQ ID NO: 18944 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18945 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcaacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18946 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18947 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaactacggctccctcaacttccgctcccgcatctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18948 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18949 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcatcgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18950 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18951 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcgccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18952 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18953 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18954 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18955 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18956 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagggccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18957 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtccccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttcccccacgacctccgc

SEQ ID NO: 18958 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18959 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18960 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18961 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18962 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccgagtccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18963 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccaccctccgc

SEQ ID NO: 18964 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18965 - RNA, 420 nt, synthetic construct
  misc_feature 1..420: note = derived and/or modified sequence opt2 from anti-HIV-1_HeavyChain
  source 1..420: mol_type = other RNA
caggcccgccccggcgccaaccgcggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18966 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcctccaccaagggcccctccgtcttcccccacgacctccgc

SEQ ID NO: 18967 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttcccccacgacctccgc

SEQ ID NO: 18968 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcctccccccccgctccgcc

SEQ ID NO: 18969 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcatgaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18970 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaaggagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccagaccctccgc

SEQ ID NO: 18971 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18972 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18973 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18974 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18975 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaactacggctccctcaacttccgctcccgcatctccctcacccgcgaccgcgacctcttcaccgcccacatggacatccgcggcctcaccgagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18976 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgcctcgcctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18977 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18978 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18979 - RNA, 417 nt, synthetic construct
  misc_feature 1..417: note = derived and/or modified sequence opt2 from anti-HIV-1_HeavyChain
  source 1..417: mol_type = other RNA
caggtccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18980 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccagcgcgtctccctcacccgcgaccgcgacctcttcaccgcccacatggacatccgcggcctcacccagggcgacaccgccacctacctctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18981 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttcccccacgacctccgc

SEQ ID NO: 18982 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccccgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggctcctccgtcttcccccacgacctccgc

SEQ ID NO: 18983 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccccgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18984 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18985 - RNA, 417 nt, synthetic construct
  misc_feature 1..417: note = derived and/or modified sequence opt2 from anti-HIV-1_HeavyChain
  source 1..417: mol_type = other RNA
caggtccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccaccgctccacc

SEQ ID NO: 18986 - RNA, 420 nt, synthetic construct
  misc_feature 1..420: note = derived and/or modified sequence opt2 from anti-HIV-1_HeavyChain
  source 1..420: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcaccatctacgtc

SEQ ID NO: 18987 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgaccccgcc

SEQ ID NO: 18988 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcctccccccccgctccacc

SEQ ID NO: 18989 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18990 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccgagtggaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 18991 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccgaggtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18992 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18993 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcctccgcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 18994 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccgcctccggcgtcaagcgccccggcgcctccgtccgcgtctcctgcctcgcctccgaggacatcttcgagcgctccgagctcatctactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 18995 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttcccccacgacctccgc

SEQ ID NO: 18996 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccgcctccggcgtcaagcgccccggcgcctccgtccgcgtctcctgctggacctccgaggacatcttcgagcgctccgagctcatctactgggtccgccaggcccccggccagggcctcgagtggatcggctgggtcaagaccgtctccggcgccgtcaacttcggctccaccgacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 18997 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccggcctccccccccgctccgcc

SEQ ID NO: 18998 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttccccctccgctccgcc

SEQ ID NO: 18999 - RNA, 423 nt, synthetic construct
  misc_feature 1..423: note = derived and/or modified sequence opt2 from anti-HIV-1_HeavyChain
  source 1..423: mol_type = other RNA
caggtccagatggagcaggccggcgccggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgcctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttcccccacgacctccgc

SEQ ID NO: 19000 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttcccccagatctgccgc

SEQ ID NO: 19001 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggcgccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacctcgtccaccagatctccgaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19002 - RNA, 420 nt, synthetic construct
  misc_feature 1..420: note = derived and/or modified sequence opt2 from anti-HIV-1_HeavyChain
  source 1..420: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccggcctccccccccgcctctgcgtc

SEQ ID NO: 19003 - RNA, 417 nt, synthetic construct
  misc_feature 1..417: note = derived and/or modified sequence opt2 from anti-HIV-1_HeavyChain
  source 1..417: mol_type = other RNA
caggcccgcctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgactccgcc

SEQ ID NO: 19004 - RNA, 414 nt, synthetic construct
  misc_feature 1..414: note = derived and/or modified sequence opt2 from anti-HIV-1_HeavyChain
  source 1..414: mol_type = other RNA
caggtccagctcgtccagtccggcgccgaggtcaagaagcccggctcctccgtcaaggtctcctgcaaggtctccggcggcgtcttcacctcctacgccgtcacctgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19005 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 19006 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtcaccgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgacgacctccgc

SEQ ID NO: 19007 - RNA, 414 nt, synthetic construct
  misc_feature 1..414: note = derived and/or modified sequence opt2 from anti-HIV-1_HeavyChain
  source 1..414: mol_type = other RNA
caggtccagctcgtccagtccggcgccgaggtcaagaagcccggcgcctccgtcaaggtctcctgcaagtcctccggctactccttcacccgcttcgacatcacctgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19008 - RNA, 420 nt, synthetic construct
  misc_feature 1..420: note = derived and/or modified sequence opt2 from anti-HIV-1_HeavyChain
  source 1..420: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggccccatcggcctccccccccgcctctgcgtc

SEQ ID NO: 19009 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 19010 - RNA, 420 nt, synthetic construct
  misc_feature 1..420: note = derived and/or modified sequence opt2 from anti-HIV-1_HeavyChain
  source 1..420: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccggcccctcccccgagatctgcgtc

SEQ ID NO: 19011 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggcgccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19012 - RNA, 417 nt, synthetic construct
  misc_feature 1..417: note = derived and/or modified sequence opt2 from anti-HIV-1_HeavyChain
  source 1..417: mol_type = other RNA
cgcgcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgccaactacggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 19013 - RNA, 417 nt, synthetic construct
  misc_feature 1..417: note = derived and/or modified sequence opt2 from anti-HIV-1_HeavyChain
  source 1..417: mol_type = other RNA
caggtccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19014 - RNA, 417 nt, synthetic construct
  misc_feature 1..417: note = derived and/or modified sequence opt2 from anti-HIV-1_HeavyChain
  source 1..417: mol_type = other RNA
cgcgcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgcctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttccccaccatctacgtc

SEQ ID NO: 19015 - RNA, 414 nt, synthetic construct
  misc_feature 1..414: note = derived and/or modified sequence opt2 from anti-HIV-1_HeavyChain
  source 1..414: mol_type = other RNA
caggtccagctcgtccagtccgaggccgaggtcaagaagcccggcgcctccgtcaagatctcctgcgccacctccggctacgccttcaccctctactacctccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctccgcctccaccaagggcccctccgtcttcccccacgacctccgc

SEQ ID NO: 19016 - RNA, 420 nt, synthetic construct
  misc_feature 1..420: note = derived and/or modified sequence opt2 from anti-HIV-1_HeavyChain
  source 1..420: mol_type = other RNA
caggcccaccccgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccggcctccccccccgcctctgcgtc

SEQ ID NO: 19017 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttccccccccgctccacc

SEQ ID NO: 19018 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagcgccccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 19019 - RNA, 417 nt, synthetic construct
  misc_feature 1..417: note = derived and/or modified sequence opt2 from anti-HIV-1_HeavyChain
  source 1..417: mol_type = other RNA
ggcgcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 19020 - RNA, 417 nt, synthetic construct
  misc_feature 1..417: note = derived and/or modified sequence opt2 from anti-HIV-1_HeavyChain
  source 1..417: mol_type = other RNA
cgccacgacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttcccccacgacctccgc

SEQ ID NO: 19021 - RNA, 420 nt, synthetic construct
  misc_feature 1..420: note = derived and/or modified sequence opt2 from anti-HIV-1_HeavyChain
  source 1..420: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcaccatctacgtc

SEQ ID NO: 19022 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctcccccggccccatcggcccctccccccgctccgcc

SEQ ID NO: 19023 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccgcctccggcgtcaagcgccccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 19024 - RNA, 417 nt, synthetic construct
  misc_feature 1..417: note = derived and/or modified sequence opt2 from anti-HIV-1_HeavyChain
  source 1..417: mol_type = other RNA
caggtccagctcgtccagtccggcgccgaggtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctacgtc

SEQ ID NO: 19025 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagcgcatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttccccaccatctgcgtc

SEQ ID NO: 19026 - RNA, 420 nt, synthetic construct
  misc_feature 1..420: note = derived and/or modified sequence opt2 from anti-HIV-1_HeavyChain
  source 1..420: mol_type = other RNA
cagtcccacctcgagcagtccggctccgccatgaagaagcccggcgcctccgtccgcgtctcctgctggacctccgaggacatcttcgacaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaacggccccatcggcccctcccccaccgacctccgc

SEQ ID NO: 19027 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccagtgggtccgccaggcccccggccagggcctcgagtggatgggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19028 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19029 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctacgtc

SEQ ID NO: 19030 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacccccgc

SEQ ID NO: 19031 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttcccccacgacctccgc

SEQ ID NO: 19032 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccgcggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttccccaccatctacgtc

SEQ ID NO: 19033 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttccccaccatctacgtc

SEQ ID NO: 19034 - RNA, 423 nt, synthetic construct
  misc_feature 1..423: note = derived and/or modified sequence opt2 from anti-HIV-1_HeavyChain
  source 1..423: mol_type = other RNA
caggtctactccggcgccggccgcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttccccaccatctacgtc

SEQ ID NO: 19035 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgccttcaccaagggcccctccgtcttcccccacgacctccgc

SEQ ID NO: 19036 - RNA, 414 nt, synthetic construct
  misc_feature 1..414: note = derived and/or modified sequence opt2 from anti-HIV-1_HeavyChain
  source 1..414: mol_type = other RNA
caggtccagctcggccagtccggcgccgagatgaagaagcccggctcctccgtcaaggtctcctgcaaggcctccggcggcaccttccgccactcccccatctcctgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19037 - RNA, 417 nt, synthetic construct
  misc_feature 1..417: note = derived and/or modified sequence opt2 from anti-HIV-1_HeavyChain
  source 1..417: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 19038 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcctgggtcatcgtctcctccgcctccaccaagggcccctccgtcttcccccacgacctccgc

SEQ ID NO: 19039 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttccccaccatctgcgtc

SEQ ID NO: 19040 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19041 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttccccaccatctacgtc

SEQ ID NO: 19042 - RNA, 423 nt, synthetic construct
  misc_feature 1..423: note = derived and/or modified sequence opt2 from anti-HIV-1_HeavyChain
  source 1..423: mol_type = other RNA
caggtcttcatggagcaggccggcgccggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19043 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcctcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19044 - RNA, 420 nt, synthetic construct
  misc_feature 1..420: note = derived and/or modified sequence opt2 from anti-HIV-1_HeavyChain
  source 1..420: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttccccaccatc

SEQ ID NO: 19045 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttccccaccatctgcgtc

SEQ ID NO: 19046 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcctccaccaagggcccctccgtcttcccccacgacctccgc

SEQ ID NO: 19047 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19048 - RNA, 423 nt, synthetic construct
  misc_feature 1..423: note = derived and/or modified sequence opt2 from anti-HIV-1_HeavyChain
  source 1..423: mol_type = other RNA
caggtctacatgggcgccggccgcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttccccaccatctacgtc

SEQ ID NO: 19049 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttccccaccatctgcgtc

SEQ ID NO: 19050 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttcccccacgacctccgc

SEQ ID NO: 19051 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggcaaggtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19052 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagtcccgcgtctccttctacggcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19053 - RNA, 420 nt, synthetic construct
  misc_feature 1..420: note = derived and/or modified sequence opt2 from anti-HIV-1_HeavyChain
  source 1..420: mol_type = other RNA
cagggccacaccgtcgagcagtccggctccggcgtcaagaagctcggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19054 - RNA, 420 nt, synthetic construct
  misc_feature 1..420: note = derived and/or modified sequence opt2 from anti-HIV-1_HeavyChain
  source 1..420: mol_type = other RNA
caggccaccccctggtccaacctcggccgcggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctccgcctccaccaagggcccctccgtcttcccccacgacctccgc

SEQ ID NO: 19055 - RNA, 423 nt, synthetic construct
  misc_feature 1..423: note = derived and/or modified sequence opt2 from anti-HIV-1_HeavyChain
  source 1..423: mol_type = other RNA
caggtcttcatggagcaggccggcgccggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcccccacgacctccgc

SEQ ID NO: 19056 - RNA, 423 nt, synthetic construct
  misc_feature 1..423: note = derived and/or modified sequence opt2 from anti-HIV-1_HeavyChain
  source 1..423: mol_type = other RNA
caggtctacatggagcagtccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19057 - RNA, 423 nt, synthetic construct
  misc_feature 1..423: note = derived and/or modified sequence opt2 from anti-HIV-1_HeavyChain
  source 1..423: mol_type = other RNA
caggtctacatggagcgcggccgcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19058 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgccgcttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttccccaccatctgcgtc

SEQ ID NO: 19059 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcccccacgacctccgc

SEQ ID NO: 19060 - RNA, 423 nt, synthetic construct
  misc_feature 1..423: note = derived and/or modified sequence opt2 from anti-HIV-1_HeavyChain
  source 1..423: mol_type = other RNA
caggtcttcatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttcccccacgacctccgc

SEQ ID NO: 19061 - RNA, 423 nt, synthetic construct
  misc_feature 1..423: note = derived and/or modified sequence opt2 from anti-HIV-1_HeavyChain
  source 1..423: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctc

SEQ ID NO: 19062 - RNA, 423 nt, synthetic construct
  misc_feature 1..423: note = derived and/or modified sequence opt2 from anti-HIV-1_HeavyChain
  source 1..423: mol_type = other RNA
caggtcttcatggagcaggccggcgccggcatgaagaagcccggcgcctccatgaccgtctcctgcaagaccgccgacgaggacgtcttcgacgccgcctacatgcactgggtccgccaggcccccggccccgacctcgagtggctcggctggatgaagcccgtcaccggcgccgtcaactacgcccgcaagttccagggccgcgtctccttctaccgcacccgcgagctcggcatcgcctacatggacctccgcgacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaaggcccaccgctcctcccccaccatctgcgtc

SEQ ID NO: 19063 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19064 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcaacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcccccacgacctccgc

SEQ ID NO: 19065 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccggcctcccccacgacctccgc

SEQ ID NO: 19066 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacggcaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19067 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttcccccacgacctccgc

SEQ ID NO: 19068 - RNA, 423 nt, synthetic construct
  misc_feature 1..423: note = derived and/or modified sequence opt2 from anti-HIV-1_HeavyChain
  source 1..423: mol_type = other RNA
caggtccagctcgtccagtccggcgccgaggtcaagaagcccggcgcctccctcaaggtctcctgcaaggcctccggctacaccttcaccgactactacatccactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19069 - RNA, 423 nt, synthetic construct
  misc_feature 1..423: note = derived and/or modified sequence opt2 from anti-HIV-1_HeavyChain
  source 1..423: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcaccctcatcgtcgtctcctccgcctccacccgcgcccaccgctccccccacgacctccgc

SEQ ID NO: 19070 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19071 - RNA, 426 nt, synthetic construct
  misc_feature 1..426: note = derived and/or modified sequence opt2 from anti-HIV-1_HeavyChain
  source 1..426: mol_type = other RNA
caggtccagctcgtccagtccggcgccgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccagatctgcgtc

SEQ ID NO: 19072 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctggatgaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaaggcccaccgctcctcccccaccaccctccgc

SEQ ID NO: 19073 - RNA, 423 nt, synthetic construct
  misc_feature 1..423: note = derived and/or modified sequence opt2 from anti-HIV-1_HeavyChain
  source 1..423: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttcccccgctccgcc

SEQ ID NO: 19074 - RNA, 423 nt, synthetic construct
  misc_feature 1..423: note = derived and/or modified sequence opt2 from anti-HIV-1_HeavyChain
  source 1..423: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggccaccagatctccgaccgcgtctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19075 - RNA, 423 nt, synthetic construct
  misc_feature 1..423: note = derived and/or modified sequence opt2 from anti-HIV-1_HeavyChain
  source 1..423: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccacccgcgcccaccgctcctccccccgctccgcc

SEQ ID NO: 19076 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19077 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttccccaccatctacgtc

SEQ ID NO: 19078 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19079 - RNA, 423 nt, synthetic construct
  misc_feature 1..423: note = derived and/or modified sequence opt2 from anti-HIV-1_HeavyChain
  source 1..423: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttccccaccatctgc

SEQ ID NO: 19080 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgccctccaccagggccccatcggcctccccccccgctccacc

SEQ ID NO: 19081 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcctccccccccgctccgcc

SEQ ID NO: 19082 - RNA, 423 nt, synthetic construct
  misc_feature 1..423: note = derived and/or modified sequence opt2 from anti-HIV-1_HeavyChain
  source 1..423: mol_type = other RNA
caggtccagctcgtccagtccggcgccgaggtcaagaagcccggcgcctccgtcaagatctcctgcaaggcctccggctacaccttcatccgccacggcatccactggctccgccaggtccccggccagcgccccgagtggatgggctggatccgccccaagaccggcgcccgcaaccaggcccgccagttccagccccgcatctccctcgcccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctccgccctccaccagggccccatcggcctccccccccgctccacc

SEQ ID NO: 19083 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19084 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacctctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19085 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccagatctgcgtc

SEQ ID NO: 19086 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19087 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctccgcctccaccaagggcccctccgtcttccccaccatctgcgtc

SEQ ID NO: 19088 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19089 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttccccaccatctgcgtc

SEQ ID NO: 19090 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttccccaccatctgcgtc

SEQ ID NO: 19091 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggccaccgctcctcccccaccatctgcgtc

SEQ ID NO: 19092 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttccccaccatctacgtc

SEQ ID NO: 19093 - RNA, 423 nt, synthetic construct
  misc_feature 1..423: note = derived and/or modified sequence opt2 from anti-HIV-1_HeavyChain
  source 1..423: mol_type = other RNA
cagtcccacctcgagcagtccggctccgccatgaagaagcccggcgcctccgtccgcgtctcctgctggacctccgaggacatcttcgacaccaccgagctctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19094 - RNA, 423 nt, synthetic construct
  misc_feature 1..423: note = derived and/or modified sequence opt2 from anti-HIV-1_HeavyChain
  source 1..423: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttcccccacgaccccgcc

SEQ ID NO: 19095 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19096 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttccccaccatctgcgtc

SEQ ID NO: 19097 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccgcctccggcgtcaagcgccccggcgcctccgtccgcgtctcctgctggacctccgaggacatcttcgagcgcaccgagctcatctactgggtccgccaggcccccggccagggcctcgagtggatcggctgggtcaagaccgtctccggcgccgtcaacttcggctcccaggacttccgcgaccgcttctccctcacccgcgaccgcgacctcttcaccgcccacatggacatccgcggcctcacccagggcgacaccgccacctacttctgcgcccgccagaagttcgcctcccgctactccggcgaccagggctcctacttcgacctctggggccgcggcaccctcatcgtcgtctcctccgcctccaccaagggcccctccgtcttccccaccatctgcgtc

SEQ ID NO: 19098 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19099 - RNA, 423 nt, synthetic construct
  misc_feature 1..423: note = derived and/or modified sequence opt2 from anti-HIV-1_HeavyChain
  source 1..423: mol_type = other RNA
caggtccacatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttcctccaggaccagggcatccgcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcctccctccaccagggccccatcggcctccccccccgctccgcc

SEQ ID NO: 19100 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctacgtc

SEQ ID NO: 19101 - RNA, 426 nt, synthetic construct
  misc_feature 1..426: note = derived and/or modified sequence opt2 from anti-HIV-1_HeavyChain
  source 1..426: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaacttccagggccgcgtctccttctaccgcacccgcgagctcggcatcgcctacatggacctccgcaacctccgcttcgacgacaccgccgtctacttctgcgcccgcaagaccaagggcgacgtctccggcgacgaccgcggcttcttcttcgacctctggggccgcggcacccgcgtcatcgtctcctccggcctccaccagcgcgcccaccgctcctcccccaccatctgcgtc

SEQ ID NO: 19102 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttccccaccatctgcgtc

SEQ ID NO: 19103 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgtcggcgtcaagaagcccggcgcctccgtcaccctctcctgcaagaccgccgacgaggacgtcttcgacgccgcctacatgcactgggtccgccaggcccccggccccgacctcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctccgcctccaccaagggcccctccgtcttccccaccatctgcgtc

SEQ ID NO: 19104 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttcccccacgacctccgc

SEQ ID NO: 19105 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19106 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagcgcatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19107 - RNA, 423 nt, synthetic construct
  misc_feature 1..423: note = derived and/or modified sequence opt2 from anti-HIV-1_HeavyChain
  source 1..423: mol_type = other RNA
gaggtctacatggagcgcggccgcggcggcgtcaagaagcccggcgcctccgccaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcccccacgacctccgc

SEQ ID NO: 19108 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgcccgcgtctcctgctggtcctccgaggacatcttcgagcgcatcgagctcatccactgggtccgccaggcccccggccagggcctcgagtggatcggctgggtcaagaccgtcgccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19109 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctccgcctccaccaagggcccctccgtcttccccaccatctacgtc

SEQ ID NO: 19110 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaacggcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19111 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19112 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccggcgacatcctccgcaagtccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19113 - RNA, 426 nt, synthetic construct
  misc_feature 1..426: note = derived and/or modified sequence opt2 from anti-HIV-1_HeavyChain
  source 1..426: mol_type = other RNA
caggtccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctgcaccaagggcccctccgtcttcccccacgacctccgc

SEQ ID NO: 19114 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtcctggtccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19115 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggccccgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19116 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatcctccgc

SEQ ID NO: 19117 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcgccgtctcctccgcctccaccaagggcccctccgtcttcccccacgacctccgc

SEQ ID NO: 19118 - RNA, 426 nt, synthetic construct
  misc_feature 1..426: note = derived and/or modified sequence opt2 from anti-HIV-1_HeavyChain
  source 1..426: mol_type = other RNA
cagtcccacctcaagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19119 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcgagtgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19120 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgagtcccgctactccggcgaccagggctcctacttcgacctctggggccgcggcaccctcatcatcgtctcctccgcctccaccaagggcccctccgtcttcccccacgacctccgc

SEQ ID NO: 19121 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19122 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccagcgcgtctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttcccccacgacctccgc

SEQ ID NO: 19123 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19124 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19125 - RNA, 426 nt, synthetic construct
  misc_feature 1..426: note = derived and/or modified sequence opt2 from anti-HIV-1_HeavyChain
  source 1..426: mol_type = other RNA
caggtccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19126 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctccgcctccaccaagggcccctccgtcttcccccacgacctccgc

SEQ ID NO: 19127 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcgtcgcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcccccacgacctccgc

SEQ ID NO: 19128 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcaacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctccgcctccaccaagggcccctccgtcttcccccacgacctccgc

SEQ ID NO: 19129 - RNA, 423 nt, synthetic construct
  misc_feature 1..423: note = derived and/or modified sequence opt2 from anti-HIV-1_HeavyChain
  source 1..423: mol_type = other RNA
caggtccagctcgtccagtccggcgccgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttccccaccatctacgtc

SEQ ID NO: 19130 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcgtccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19131 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggccccctcggcctcccccacgacctccgc

SEQ ID NO: 19132 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19133 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttcccccacgacctccgc

SEQ ID NO: 19134 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19135 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19136 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19137 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgcccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcacccacatcgtcgtctcctccgcctccaccaagggcccctccgtcttcccccacgacctccgc

SEQ ID NO: 19138 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19139 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19140 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttcccccacgacctccgc

SEQ ID NO: 19141 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccgcatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttccccaccgacctccgc

SEQ ID NO: 19142 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19143 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaacggccccatcggcctcccccacgacctccgc

SEQ ID NO: 19144 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19145 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19146 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccggcctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19147 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccagatcttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19148 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19149 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgaggtcaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19150 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcggcggcgtcaagaagcccggcgcctccgtcaccctctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctccgcctccaccaagggcccctccgtcttcccccacgacctccgc

SEQ ID NO: 19151 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttcccccacgacctccgc

SEQ ID NO: 19152 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19153 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccgccaagggcccctccgtcttcccccacgacctccgc

SEQ ID NO: 19154 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgagcgcaccgagctcatctactgggtccgccaggcccccggccgcggcctcgagtggatcggctgggtcaagaccgtctccggcaccgtcaacttcggctcctccgacttccgcaaccgcatctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcgtcgtctcctccgcctccaccaagggcccctccgtcttccccccccgctccgcc

SEQ ID NO: 19155 - RNA, 426 nt, synthetic construct
  misc_feature 1..426: note = derived and/or modified sequence opt2 from anti-HIV-1_HeavyChain
  source 1..426: mol_type = other RNA
caggtccacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccaagggcgacgtctccggcgacgaccgcggcttcttcttcgacctctggggccgcggcacccgcgtcatcgtctcctccgcctccaccaagggccccctccgctccttcccccgccgctccgcc

SEQ ID NO: 19156 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctacgtc

SEQ ID NO: 19157 - RNA, 426 nt, synthetic construct
  misc_feature 1..426: note = derived and/or modified sequence opt2 from anti-HIV-1_HeavyChain
  source 1..426: mol_type = other RNA
gagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttcccccacgacctccgc

SEQ ID NO: 19158 - RNA, 429 nt, synthetic construct
  misc_feature 1..429: note = derived and/or modified sequence opt2 from anti-HIV-1_HeavyChain
  source 1..429: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccggcctccccccccgctcctgcgtc

SEQ ID NO: 19159 - RNA, 423 nt, synthetic construct
  misc_feature 1..423: note = derived and/or modified sequence opt2 from anti-HIV-1_HeavyChain
  source 1..423: mol_type = other RNA
caggtccacctcgtccagtccggcgccgaggtcaagaagcccggcgcctccgtcaaggtctcctgcaaggcctccggctacaccttcaccacctccggcatccactggctccgccaggtccccggccagcgccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctccgcctccaccaagggcccctccgtcttcccccacgacctccgc

SEQ ID NO: 19160 - RNA, 429 nt, synthetic construct
  misc_feature 1..429: note = derived and/or modified sequence opt2 from anti-HIV-1_HeavyChain
  source 1..429: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccacccagggccccatcggcctccccccccgcctctgcgtc

SEQ ID NO: 19161 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggccccatcggcctccccccccgctccacc

SEQ ID NO: 19162 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19163 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgccctccaccagggccccatcggcctccccccccgctccacc

SEQ ID NO: 19164 - RNA, 429 nt, synthetic construct
  misc_feature 1..429: note = derived and/or modified sequence opt2 from anti-HIV-1_HeavyChain
  source 1..429: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcgtctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgccctccaccagggccccatcggcccctcccccaccatcctccgc

SEQ ID NO: 19165 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccgtcttccccaccatctacgtc

SEQ ID NO: 19166 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19167 - RNA, 426 nt, synthetic construct
  misc_feature 1..426: note = derived and/or modified sequence opt2 from anti-HIV-1_HeavyChain
  source 1..426: mol_type = other RNA
caggtccagctcgtccagtccggcgccgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19168 - RNA, 426 nt, synthetic construct
  misc_feature 1..426: note = derived and/or modified sequence opt2 from anti-HIV-1_HeavyChain
  source 1..426: mol_type = other RNA
cgccgccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19169 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgagtcccgctactccggcgaccagggctcctacttcgacctctggggccgcggcaccctcatcatcgtctcctccgcctccaccaagggcccctccgtcttccccaccatctgcgtc

SEQ ID NO: 19170 - RNA, 429 nt, synthetic construct
  misc_feature 1..429: note = derived and/or modified sequence opt2 from anti-HIV-1_HeavyChain
  source 1..429: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccccaccccgtcttcccccacgacctcccc

SEQ ID NO: 19171 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagctcggcgcctccgtccgcgtctcctgctggacctccgaggacatcttcgagcgcaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttccccaccatctacgtc

SEQ ID NO: 19172 - RNA, 429 nt, synthetic construct
  misc_feature 1..429: note = derived and/or modified sequence opt2 from anti-HIV-1_HeavyChain
  source 1..429: mol_type = other RNA
caggcccacctcgagcagtccggctccggcgtcaagaagcccggcgcctccgtccgcgtctcctgctggacctccgaggacatcttcgagcgcaccgagctcatccactgggcccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggccccctcggcctccccccccgcctctcccgc

SEQ ID NO: 19173 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctccgcctccaccaagggcccctccggcctccccccccgctccgcc

SEQ ID NO: 19174 - RNA, 426 nt, synthetic construct
  misc_feature 1..426: note = derived and/or modified sequence opt2 from anti-HIV-1_HeavyChain
  source 1..426: mol_type = other RNA
caggtccagctcgtccagtccggcgccgaggtcaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctccgccaggacgacaccgccacctacttctgcgcccgccagaagttcgagtcccgctactccggcgaccagggctcctacttcgacctctggggccgcggcaccctcatcatcgtctcctccgcctccaccaagggcccctccgtcttcccccacgacctccgc

SEQ ID NO: 19175 - RNA, 426 nt, synthetic construct
  misc_feature 1..426: note = derived and/or modified sequence opt2 from anti-HIV-1_HeavyChain
  source 1..426: mol_type = other RNA
gaggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19176 - RNA, 423 nt, synthetic construct
  misc_feature 1..423: note = derived and/or modified sequence opt2 from anti-HIV-1_HeavyChain
  source 1..423: mol_type = other RNA
caggtccagctcgtccagtccggcgccgaggtcaagaagcccggcgcctccgtcaaggtctcctgccgcgcctccggctacaccttcggcaaccacgccatctcctgggtccgccaggcccccggccagggcctcgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctccgcctccaccaagggcccctccgtcttcccccacgacctccgc

SEQ ID NO: 19177 - RNA, 429 nt, synthetic construct
  misc_feature 1..429: note = derived and/or modified sequence opt2 from anti-HIV-1_HeavyChain
  source 1..429: mol_type = other RNA
cagggccacaacctcgagcagtccggctccgaggtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttcccccacgacctccgc

SEQ ID NO: 19178 - RNA, 426 nt, synthetic construct
  misc_feature 1..426: note = derived and/or modified sequence opt2 from anti-HIV-1_HeavyChain
  source 1..426: mol_type = other RNA
cccaccacctggaacaagtccggctccgacgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctctccaccgcccacatggacatccgcggcctcacccaggacgacaccgccacctacttctgcgcccgccagaagttcgagtccctctactccgacgaccagggctcctacttcgacctctggggccgcggcaccctcatcatcgtctcctccgcctccaccaagggcccctccgtcttcccccacgacctccgc

SEQ ID NO: 19179 - RNA, 432 nt, synthetic construct
  misc_feature 1..432: note = derived and/or modified sequence opt2 from anti-HIV-1_HeavyChain
  source 1..432: mol_type = other RNA
cacgtcaccccctggaacgagtacgtcggccgcgccatgaagaagcccggccgctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttcccccacgacctccgc

SEQ ID NO: 19180 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtccgccgccccggcgcctccgtcaaggtctcctgcaaggcctccggcttctccttcctcggccactacatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 19181 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtcaaggtctcctgcaaggcctccggctacaccttcacctcctacggcatctcctgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 19182 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccgaggccgaggtcaagaagcccggcgcctccgtcaagatctcctgcgccacctccggctacgccttcaccctctactacctccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 19183 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19184 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtccccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 19185 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacccccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 19186 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccgcctccggcgtcaagcgccccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 19187 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 19188 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcgccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 19189 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19190 - RNA, 375 nt, synthetic construct
  misc_feature 1..375: note = derived and/or modified sequence opt2 from anti-HIV-1_HeavyChain
  source 1..375: mol_type = other RNA
caggtccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 19191 - RNA, 375 nt, synthetic construct
  misc_feature 1..375: note = derived and/or modified sequence opt2 from anti-HIV-1_HeavyChain
  source 1..375: mol_type = other RNA
caggcctacctcgagcagtccggctccatcatgaagaagcccggcgcctccgtccgcgtctcctgctggacctccgaggacatcttcgaccgcaccgagctcatctactgggtccgccaggcccccggccagggcctcgagtggatcggctgggtcaagatcgtctccggcgccgtcaacttcggctccctcgacttccgcaaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19192 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatcaactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 19193 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19194 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 19195 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccggcgacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 19196 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacaccgacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19197 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgcctcgcctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19198 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccgcggcaccctcatcgtcgtctcctcc

SEQ ID NO: 19199 - RNA, 375 nt, synthetic construct
  misc_feature 1..375: note = derived and/or modified sequence opt2 from anti-HIV-1_HeavyChain
  source 1..375: mol_type = other RNA
cgccacacctggaacaagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctcc

SEQ ID NO: 19200 - RNA, 375 nt, synthetic construct
  misc_feature 1..375: note = derived and/or modified sequence opt2 from anti-HIV-1_HeavyChain
  source 1..375: mol_type = other RNA
ggcacccccggctccgagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 19201 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcaccgaggtccagaagcccggcgcctccgtcaaggtctcctgcaaggccttcggctactccttcaccgactactacgtctactgggtccgccaggcccccggccagggcctcgagtacgtcgcctggatcaacccctccaacggctacaccaagtacgcccagaagttccaggactgggtcaccctcacccgcgactcctccatcaacaccgcctacctccagctcgcccgcgtcacctccgacgacaccgccatctactactgcgcccgccagaagttcgcctcccgctactccggcgaccagggctcctacttcgacctctggggccgcggcaccctcatcgtcgtctcctcc

SEQ ID NO: 19202 - RNA, 378 nt, synthetic construct
  misc_feature 1..378: note = derived and/or modified sequence opt2 from anti-HIV-1_HeavyChain
  source 1..378: mol_type = other RNA
caggtccagctcgtccagtccggcgccgccgtcaagaagcccggctcctccgtcaaggtctcctgcaaggcctccggctacatcttcaccggctactacatccactggatccgccaggcccccggccagggcctcgagtggatgggctggatcaacccctccaccggcgacaccaagttcgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 19203 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcgccggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 19204 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcaggccggcggcggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 19205 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcaggccggcggcggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 19206 - RNA, 381 nt, synthetic construct
  misc_feature 1..381: note = derived and/or modified sequence opt2 from anti-HIV-1_HeavyChain
  source 1..381: mol_type = other RNA
caggtccacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 19207 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcatgaagaagcccggcgcctccatgaccgtctcctgcaagaccgccgacgaggacatcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctcc

SEQ ID NO: 19208 - RNA, 381 nt, synthetic construct
  misc_feature 1..381: note = derived and/or modified sequence opt2 from anti-HIV-1_HeavyChain
  source 1..381: mol_type = other RNA
caggtctacatggagcaggccggcggcggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcctgggtcatcgtctcctcc

SEQ ID NO: 19209 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtcaactacgcccgcaagttccagggccgcgtctccttctaccgcacccgcgagctcggcatcgcctacatggacctccgcaacctccgcttcgacgacaccgccgtctacttctgcgcccgcaagaccgccggcgacgtctccggcgacaagcgcggcttcttcttcgacctctggggccgcggctcccgcgtcatcgtctcctcc

SEQ ID NO: 19210 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcggcctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 19211 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccgcctccggcgtccgccgccccggcgcctccgtccgcgtctcctgctggacctccgaggacatcttcgagcgctccgagctcatctactgggtccgccaggcccccggccgcggcctcgagtggatcggctggatcaagctcgtctccggcgccgtcaacttcggctccgtcgacttccgcgaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19212 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaactacggctccctcaacttccgctcccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19213 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19214 - RNA, 384 nt, synthetic construct
  misc_feature 1..384: note = derived and/or modified sequence opt2 from anti-HIV-1_HeavyChain
  source 1..384: mol_type = other RNA
caggtccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19215 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctcggccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 19216 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19217 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgagggcatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 19218 - RNA, 384 nt, synthetic construct
  misc_feature 1..384: note = derived and/or modified sequence opt2 from anti-HIV-1_HeavyChain
  source 1..384: mol_type = other RNA
cagtcccgcctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcccacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 19219 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19220 - RNA, 384 nt, synthetic construct
  misc_feature 1..384: note = derived and/or modified sequence opt2 from anti-HIV-1_HeavyChain
  source 1..384: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctcctccgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcatcgtctcctcc

SEQ ID NO: 19221 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctcc

SEQ ID NO: 19222 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19223 - RNA, 384 nt, synthetic construct
  misc_feature 1..384: note = derived and/or modified sequence opt2 from anti-HIV-1_HeavyChain
  source 1..384: mol_type = other RNA
cgccacacctgggagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19224 - RNA, 414 nt, synthetic construct
  misc_feature 1..414: note = derived and/or modified sequence opt2 from anti-HIV-1_HeavyChain
  source 1..414: mol_type = other RNA
caggcccacctcgagcagtccggctccggcgtcaagaagcccggcgcctccgtccgcgtctcctgctggacctccgaggacatcttcgagcgctccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagtactacgccggcggccagggctggtacttcgacctctggggccgcggcaccctcatcgtcgtctcctccgcctccaccaagggcccctccgtcttccacgacctccgc

SEQ ID NO: 19225 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctccgcctccaccaagggcccctccgtcttccccaccatctgcgtc

SEQ ID NO: 19226 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19227 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaaggtcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccatctacttctgcgcccgccagaagttcgcccgcggcgaccagggctggttcttcgacctctggggccgcggcaccctcatcgtcgtctcctccgcctccaccaagggcccctccgtcttcccccacgacctccgc

SEQ ID NO: 19228 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 19229 - RNA, 423 nt, synthetic construct
  misc_feature 1..423: note = derived and/or modified sequence opt2 from anti-HIV-1_HeavyChain
  source 1..423: mol_type = other RNA
caggtctacatggagcaggccggcgccggcgtcaagaagcccggcgcctccgtcaccctctcctgcaagaccgccgacgaggacgtcttcgacgccgcctacatgcactgggtccgccaggcccccggccagaccttcgagtggctcggctggatgaagcccgtcaccggcgccgtctcctacgcccgcaagttccagggccgcgtctccttctacatgacccgcgagctcggcatggcctacatggacctccgcaacctccgcttcgacgacaccgccgtctacttctgcgcccgcaagaccgccggcgacgtctccggcgacaaccgcggctacttcttcgacctctggggccgcggctcccgcgtcatcgtctcctccgcctccaccaagggcccctccgtcttcccccacgacctccgc

SEQ ID NO: 19230 - RNA, 426 nt, synthetic construct
  misc_feature 1..426: note = derived and/or modified sequence opt2 from anti-HIV-1_HeavyChain
  source 1..426: mol_type = other RNA
cagtcccacctcgagcagtccggctccgccatgaagaagcccggcgcctccgtccgcgtctcctgctggacctccgaggacatcttcgacaccaccgagctcatctactgggtccgccaggcccccggccagggcctcgagtggatcggctgggtcaagatcgtctccggcaccgtcaacttcgcctccctcgacttccgcaaccgcatctccctctcccgcgaccgcgacctctccaccgcctacatggacatccgcggcctcacccaggacgacaccgccacctacttctgcgcccgccagaagttcgcctcccgctactccggcgaccagggctcctacttcgacctctggggccgcggcaccctcatcgtcgtctcctccgcctccaccaagggcccctccgtcttccccaccatctacgtc

SEQ ID NO: 19231 - RNA, 372 nt, synthetic construct
  misc_feature 1..372: note = derived and/or modified sequence opt2 from anti-HIV-1_HeavyChain
  source 1..372: mol_type = other RNA
caggtccagctcgtccagtccggcgccgaggtcaagaagcccggcgcctccgtcaaggtctcctgcaaggcctccggcggcaccctctcctcctacgccatctcctgggtccgccaggcccccggccagggcctcgagtggatcggctgggtcaagaccgtcaccggcgccgtcaacttcggctccgcctgcttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 19232 - RNA, 372 nt, synthetic construct
  misc_feature 1..372: note = derived and/or modified sequence opt2 from anti-HIV-1_HeavyChain
  source 1..372: mol_type = other RNA
cacgtccgcctcgtccagtccggcgccgaggtcgagaagcccggcgcctccgtcaaggtctcctgcgagacctccaactaccccttcaacatgtacggcatgacctgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 19233 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacgtcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttctacgccggcggccagggctggtacttcgacctctggggccgcggcaccctcatcgtcgtctcctcc

SEQ ID NO: 19234 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19235 - RNA, 375 nt, synthetic construct
  misc_feature 1..375: note = derived and/or modified sequence opt2 from anti-HIV-1_HeavyChain
  source 1..375: mol_type = other RNA
cgccacacctgggagcagtccggctccggcgtcaagcgccccggcgcctccgtccgcgtctcctgctggacctccgaggacatcttcgagaccaccgagctcatccactgggtccgccaggcccccggccagggcctcgagtggatcggctgggtcaagaccgtctccggcgccgtcaacttcggctccctcaacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 19236 - RNA, 381 nt, synthetic construct
  misc_feature 1..381: note = derived and/or modified sequence opt2 from anti-HIV-1_HeavyChain
  source 1..381: mol_type = other RNA
caggtcttcatggagcaggccggcgccggcatgaagaagcccggcgcctccatgaccgtctcctgcaagaccgccgacgaggacgtcttcgacgccgcctacatgcactgggtccgccaggcccccggccagaccttcgagtggctcggctggatgaagcccgtcaccggcgccgtcaactacgcccgccagttccagggccgcgtctccttctaccgcacccgcgagctcggcatcgcctacatggacctccgcgacctcaagttcgacgacaccgccgtctacttctgcgcccgcaagaccaagggcgacgtctccggcgacgaccgcggcttcttcttcgacctctggggccgcggcacccgcgtcatcgtctcctcc

SEQ ID NO: 19237 - RNA, 384 nt, synthetic construct
  misc_feature 1..384: note = derived and/or modified sequence opt2 from anti-HIV-1_HeavyChain
  source 1..384: mol_type = other RNA
caggtccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19238 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcctccaccaagggcccctccgtcttccccaccatctgcgtc

SEQ ID NO: 19239 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatcgtcgtctcctccgcctccaccaagggcccctccgtcttccccaccatctgcgtc

SEQ ID NO: 19240 - RNA, 417 nt, synthetic construct
  misc_feature 1..417: note = derived and/or modified sequence opt2 from anti-HIV-1_HeavyChain
  source 1..417: mol_type = other RNA
caggcccacctcgagcagtccggctccggcgtcaagaagctcggcgcctccgtccgcgtctcctgctggacctccgaggacgtcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttctacgccggcggccagggctggtacttcgacctctggggccgcggcaccctcatcgtcgtctcctccgcctccaccaagggcccctccgtcttcccccacgacctccgc

SEQ ID NO: 19241 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19242 - RNA, 384 nt, synthetic construct
  misc_feature 1..384: note = derived and/or modified sequence opt2 from anti-HIV-1_HeavyChain
  source 1..384: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctcc

SEQ ID NO: 19243 - RNA, 426 nt, synthetic construct
  misc_feature 1..426: note = derived and/or modified sequence opt2 from anti-HIV-1_HeavyChain
  source 1..426: mol_type = other RNA
caggcccacctcgagcagtccggctccggcgtcaagaagcccggcgcctccgtccgcgtctcctgctggtcctccgaggacatcttcgagcgcaccgagctcatccactgggtccgccaggcccccggccagggcctcgagtggatcggctgggtcaagaccgtcaccggcgccgtcaacttcggctccctcgacttccgccaccgcatctccctcacccgcgaccgcgacctcttcaccgcccacatggacatccgcggcctcacccagggcgacaccgccacctacttctgcgcccgccagaagttcgagtcccgctacaccggcggccagggctggtacttcgacctctggggccgcggcacccacatcgtcgtctcctccgcctccaccaagggcccctccgtcttccccaccatctgcgtc

SEQ ID NO: 19244 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19245 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaaggtctcctgcaaggcctccggctacacctacaccacctacggcgtctcctggctccgccaggtccccggccagcgccccgagtggatgggctggatccgccccaagaccggcgcccgcaaccaggcccgccagttccagccccgcatctccctcacccgcgaccgcgccctctccaccgcctacctcgacctcaactccctcacctccgccgactccggcacctacttctgcgcccgccagaccttcaagcccgacttctacttcgccgaccagggctggtccttcaacctctggggccgcggcgcccacttcatcgtctcctcc

SEQ ID NO: 19246 - RNA, 384 nt, synthetic construct
  misc_feature 1..384: note = derived and/or modified sequence opt2 from anti-HIV-1_HeavyChain
  source 1..384: mol_type = other RNA
cgcgcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgagtcccgctacaccggcggccagggctggtacttcgacctctggggccgcggcacccacatcaccgtctcctcc

SEQ ID NO: 19247 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagatcgtctccggcgccgtcaacttcggctcccccaacttccgccagcgcgtctccctcacccgcgaccgcgacctcttcaccgcccacatggacatccgcggcctcacccagggcgacaccgccacctactactgcgcccgccagaagttcgagcgcggcggccagggctggatcttcgacctctggggccgcggcaccctcatcgccgtctcctcc

SEQ ID NO: 19248 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccacggcaccctcatcgtcgtctcctcc

SEQ ID NO: 19249 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccacggcaccctcatcgtcgtctcctcc

SEQ ID NO: 19250 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgacggcgacctcttcaccgcccacatggacatccgcggcctcacccagggcgacaccgccacctacttctgcgcccgccagaagttctacgccggcggccagggctggtacttcgacctctggggccgcggcaccctcatcatcgtctcctcc

SEQ ID NO: 19251 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggccaccagatctccgaccgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccacggcaccctcatcgtcgtctcctcc

SEQ ID NO: 19252 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccacggcaccctcatcgtcgtctcctcc

SEQ ID NO: 19253 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggcgccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctactactgcgcccgccagaagttcgagcgcggcggccagggctggtacttcgacctctggggccgcggcaccctcatcgtcgtctcctcc

SEQ ID NO: 19254 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccgcggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctactactgcgcccgccagaagttcgagcgcggcggccagggctggatcttcgacctctggggccgcggcaccctcatcgccgtctcctcc

SEQ ID NO: 19255 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctactactgcgcccgccagaagttctacgccggcggccagggctggtacttcgacctctggggccgcggcaccctcatcgtcgtctcctcc

SEQ ID NO: 19256 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 19257 - RNA, 372 nt, synthetic construct
  misc_feature 1..372: note = derived and/or modified sequence opt2 from anti-HIV-1_HeavyChain
  source 1..372: mol_type = other RNA
tacgtcgagctcggcaccaacaccggccccgaggtccgcaagcccggcgcctccgtcaagatctcctgcaagacctccggctacatcttcaccgacaactacttccactggctccgccaggcccccgccgtcggcctcgagtggatgggctggatcaactcccacaacggctacaccaagtccgccaagaagttccagggccgcatcaccatgacccgcgacaccgccgtcgacaccgcctacatggagctcatcgacctcacctccgacgacaccgccacctactactgcgcccgccagaagttctacgccggcggccagggctggtacttcgacctctggggctgcggcaccctcatcgtcgtctcctcc

SEQ ID NO: 19258 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccgcggcaccctcatctgcgtctcctcc

SEQ ID NO: 19259 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctactactgcgcccgccagaagttctacgccggcggccagggctggtacttcgacctctggggccgcggcaccctcatcgtcgtctcctcc

SEQ ID NO: 19260 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagcccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatcgtcgtctcctcc

SEQ ID NO: 19261 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctactactgcgcccgccagaagttcgagcgcggcggccagggctggtacttcgacctctggggccgcggcaccctcatcgtcgtctcctcc

SEQ ID NO: 19262 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctactcctgcgcccgccagaagttcgcccgcggcgaccagggctggttcttcgacctctggggccgcggcaccctcatcgtcgtctcctcc

SEQ ID NO: 19263 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctactactgcgcccgccagaagttcgagcgcggcggccagggctggtacttcgacctctggggccgcggcaccctcatcgtcgtctcctcc

SEQ ID NO: 19264 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcaccgtcaacttcggctccctcaacttccgccagcgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccacggcaccctcatcgtcgtctcctcc

SEQ ID NO: 19265 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgaccccttcaccgcccacatggacatccgcggcctcacccagggcgacaccgccacctacttctgcgcccgccagaagttcgagcgcggcggccagggctggtacttcgacctctggggccacggcaccctcatcgtcgtctcctcc

SEQ ID NO: 19266 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatctgcggcctcacccagggcgacaccgccacctacttctgcgcccgccagaagttcgagcgcggcggccagggctggtacttcgacctctggggccacggcaccctcatcgtcgtctcctcc

SEQ ID NO: 19267 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccagcgcgtctccctcacccgcgaccgcgacctcttcaccgcccacatggacatccgcggcctcacccagggcgacaccgccacctactactgcgcccgccagaagttctacgccggcggccagggctggtacttcgacctctggggccgcggcaccctcatcgtcgtctcctcc

SEQ ID NO: 19268 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctacttctgcgcccgccagaagttctacgccggcggccagggctggtacttcgacctctggggccacggcaccctcatcgtcgtctcctcc

SEQ ID NO: 19269 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgcccgcggcgaccagggctggttcttcgacctctggggccacggcaccctcatcgtcgtctcctcc

SEQ ID NO: 19270 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctactactgcgcccgccagaagttcgcccgcggcgaccagggctggttcttcgacctctggggccgcggcaccctcatcgtcgtctcctcc

SEQ ID NO: 19271 - RNA, 381 nt, synthetic construct
  misc_feature 1..381: note = derived and/or modified sequence opt2 from anti-HIV-1_HeavyChain
  source 1..381: mol_type = other RNA
caggtccagctcgtccagtccggcgccgaggtcaagaagcccggcgcctccgtcaaggtctcctgcaaggcctccggctacaccttcaccgactactacctccactgggtccgccaggcccccggccagggcctcgactgggtcggctggatcaaccccaactccggcggcaccaactacgcccagaagttccagggccgcgtcgccatgacccgcgacacctccctctcctccgtctacctcgacctcaactccctcacctccgccgactccggcacctacttctgcgcccgccagaccttcaagcccgacttctacttcgccgaccagggctggtccttcaacctctggggccagggctcccacttcatcgtctcctcc

SEQ ID NO: 19272 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagaagtccgagctcatccactgggtccgccgcgcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctactactgcgcccgccagaagttctacgccggcggccagggctggtacttcgacctctggggccgcggcaccctcatcgtcgtctcctcc

SEQ ID NO: 19273 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtcaccgtctcctgctggacctccgaggacatcttcgagaagtccgagctcatccactgggtccgccaggcccccggccagggcctcgagtggatcggctgggtcaagaccgtcaccggcgccgtcaacctcgtctaccagatctccgaccgcgtctccctcacccgcgaccgcggcctcttcaccgcccacatggacatccgcggcctcacccagggcgacaccgccacctactactgcgcccgccagaagttctacgccggcggccagggctggtacttcgacctctggggccgcggcaccctcatcgtcgtctcctcc

SEQ ID NO: 19274 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagggctccgagctcatccactgggtccgccaggcccccggccagggcctcgagtggatcggctgggtcaagaccgtcaccggcgccgtcaacttcggctccgcctacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccacggcaccctcatcgtcgtctcctcc

SEQ ID NO: 19275 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaactacggctccctcaacttccgctcccgcatctccctcacccgcgaccgcgacctcttcaccgcccacatggacatccgcggcctcaccgagggcgacaccgccacctacttctgcgcccgccagaagttctacgccggcggccagggctggtacttcgacctctggggccacggcaccctcatcgtcgtctcctcc

SEQ ID NO: 19276 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacatggccacctacttctgcgcccgccagaagttcgagcgcggcggccagggctggtacttcgacctctggggccacggcaccctcatcgtcgtctcctcc

SEQ ID NO: 19277 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaaggagcccggcacctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggatcttcgacctctggggccgcggcaccctcatcgccgtctcctcc

SEQ ID NO: 19278 - RNA, 375 nt, synthetic construct
  misc_feature 1..375: note = derived and/or modified sequence opt2 from anti-HIV-1_HeavyChain
  source 1..375: mol_type = other RNA
caggtccagctcgagcagtccggctccggcgtcaagaagctcggcgcctccgtccgcgtctcctgctggacctccgaggacatcttcggccgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccaggacgacaccgccacctactactgcgcccgccagaagttcgcccgcggcgaccagggctggttcttcgacctctggggccgcggcaccctcatcgtcgtctcctcc

SEQ ID NO: 19279 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgacgacatcttcaagaccgagctcatccactgggtccgccaggcccccggccagggcctcgagtggatcggctgggtcaagaccgtcaccggcgccgtcaacttcggctcccccaacttccgccagcgcgtctccctcacccgcgaccgcgacctcttcaccgcccacatggacatccgcggcctcacccaggacgacaccgccacctacttctgcgcccgccagaagttcgcccgcggcgaccagggctggttcttcgacctctggggccgcggcaccctcatcgtcgtctcctcc

SEQ ID NO: 19280 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcgagcgcaccgagctcatccactgggtccgccaggcccccggccagggcctcgagtggatcggctgggtcaagaccgtcaccggcgccgtcaacttcggctcccccaacttccgccaccgcgtctccctcacccgcgaccgcgacctcttcaccgcccacatggacatccgcggcctcacccagggcgacaccgccacctactactgcgtccgccagaagttcgagcgcggcggccagggctggtacttcgacctctggggccgcggcaccctcatcgtcgtctcctcc

SEQ ID NO: 19281 - RNA, 375 nt, synthetic construct
  misc_feature 1..375: note = derived and/or modified sequence opt2 from anti-HIV-1_HeavyChain
  source 1..375: mol_type = other RNA
caggtccagctcgtccagtccggcgccgaggtcaagaagcccggcgcctccgtcaaggtctcctgctggacctccgaggacatcttcgagaagtccgagctcatccactgggtccgccaggcccccggccagggcctcgagtggatcggctgggtcaagaccgtcaccggcgccgtcaacttcggctcctccgacttccgccagcgcgtctccctcacccgcgaccgcgacctcttcaccgcccacatggacatccgcggcctcacccagggcgacaccgccacctactactgcgcccgccagaagttctacgccggcggccagggctggtacttcgacctctggggccgcggcaccctcatcgtcgtctcctcc

SEQ ID NO: 19282 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagctcggcgcctccgtccgcgtctcctgctggacctccgaggacatcttcgagcgcaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctcttcaccgcccacatggacatccgcggcctcacccagggcgacaccgccacctacttctgcgcccgccagaagttctacaagggcggccagggctggtacttcgacctctggggccgcggcaccctcatcgtcgtctcctcc

SEQ ID NO: 19283 - RNA, 372 nt, synthetic construct
  misc_feature 1..372: note = derived and/or modified sequence opt2 from anti-HIV-1_HeavyChain
  source 1..372: mol_type = other RNA
caggcccacctcgagcagtccggctccggcgtcaagaagcccggcgcctccgtccgcgtctcctgctggacctccgaggacatcttcgagaagtccgagctcatccactgggtccgccaggcccccggccagggcctcgagtggatcggctgggtcaagaccgtcaccggcgccgtcaacttcgcccaccagatctccgaccgcgtctccctcacccgcgaccgcgacctcttcaccgcccacatggacatccgcggcctcacccagggcgacaccgccacctactactgcgcccgccagaagttctacgccggcggccagggctggtacttcgacctctggggccgcggcaccctcatcgtcgtctcctcc

SEQ ID NO: 19284 - RNA, 375 nt, synthetic construct
  misc_feature 1..375: note = derived and/or modified sequence opt2 from anti-HIV-1_HeavyChain
  source 1..375: mol_type = other RNA
caggcccacctcgagcagtccggctccggcgtcaagaagcccggcgcctccgtccgcgtctcctgctggacctccgaggacatcttcggccgcaccgagctcatccactgggtccgccaggcccccggccagggcctcgagtggatcggctgggtcaagaccgtctccggcgccgtcaacttcggctcccccaacttccgccaccgcgtctccctcacccgcgaccgcgacctcttcaccgcccacatggacatccgcggcctcacccagggcgacaccgccacctacttctgcgcccgccagaagttcgagcgcggcggccagggctggtacttcgacctctggggccgcggcaccctcatctgcgtctcctcc

SEQ ID NO: 19285 - RNA, 636 nt, synthetic construct
  misc_feature 1..636: note = derived and/or modified sequence opt2 from anti-HIV_5CIN_LightChain
  source 1..636: mol_type = other RNA
gagatcgtcctcacccagtcccccggcacccagtccctctcccccggcgagcgcgccaccctctcctgccgcgcctcccagtccgtcggcaacaacaagctcgcctggtaccagcagcgccccggccaggccccccgcctcctcatctacggcgcctcctcccgcccctccggcgtcgccgaccgcttctccggctccggctccggcaccgacttcaccctcaccatctcccgcctcgagcccgaggacttcgccgtctactactgccagcagtacggccagtccctctccaccttcggccagggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgc

SEQ ID NO: 19286 - RNA, 672 nt, synthetic construct
  misc_feature 1..672: note = derived and/or modified sequence opt2 from anti-HIV_5CIN_HeavyChain
  source 1..672: mol_type = other RNA
gtccagctcgtccagtccggcgccgaggtcaagcgccccggctcctccgtcaccgtctcctgcaaggcctccggcggctccttctccacctacgccctctcctgggtccgccaggcccccggccgcggcctcgagtggatgggcggcgtcatccccctcctcaccatcaccaactacgccccccgcttccagggccgcatcaccatcaccgccgaccgctccacctccaccgcctacctcgagctcaactccctccgccccgaggacaccgccgtctactactgcgcccgcgagggcaccaccggctccggcggcaagcccatcggcgccttcgcccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagccc

SEQ ID NO: 19287 - RNA, 678 nt, synthetic construct
  misc_feature 1..678: note = derived and/or modified sequence opt2 from anti-HIV_5CIL_HeavyChain
  source 1..678: mol_type = other RNA
gtccagctcgtccagtccggcgccgaggtcaagcgccccggctcctccgtcaccgtctcctgcaaggcctccggcggctccttctccacctacgccctctcctgggtccgccaggcccccggccgcggcctcgagtggatgggcggcgtcatccccctcctcaccatcaccaactacgccccccgcttccagggccgcatcaccatcaccgccgaccgctccacctccaccgcctacctcgagctcaactccctccgccccgaggacaccgccgtctactactgcgcccgcgagggcaccaccggcgacggcgacctcggcaagcccatcggcgccttcgcccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagccc

SEQ ID NO: 19288 - RNA, 678 nt, synthetic construct
  misc_feature 1..678: note = derived and/or modified sequence opt2 from anti-HIV_5CIP_A-Chain
  source 1..678: mol_type = other RNA
gtccagctcgtccagtccggcgccgaggtcaagcgccccggctcctccgtcaccgtctcctgcaaggcctccggcggctccttctccacctacgccctctcctgggtccgccaggcccccggccgcggcctcgagtggatgggcggcgtcatccccctcctcaccatcaccaactacgccccccgcttccagggccgcatcaccatcaccgccgaccgctccacctccaccgcctacctcgagctcaactccctccgccccgaggacaccgccgtctactactgcgcccgcgagggcaccaccggctggggctggctcggcaagcccatcggcgccttcgcccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagccc

SEQ ID NO: 19289 - RNA, 681 nt, synthetic construct
  misc_feature 1..681: note = derived and/or modified sequence opt2 from anti-HIV_5CIP_HeavyChain
  source 1..681: mol_type = other RNA
gtccagctcgtccagtccggcgccgaggtcaagcgccccggctcctccgtcaccgtctcctgcaaggcctccggcggctccttctccacctacgccctctcctgggtccgccaggcccccggccgcggcctcgagtggatgggcggcgtcatccccctcctcaccatcaccaactacgccccccgcttccagggccgcatcaccatcaccgccgaccgctccacctccaccgcctacctcgagctcaactccctccgccccgaggacaccgccgtctactactgcgcccgcgagggcaccaccggctggggctggctcggcaagcccatcggcgccttcgcccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaag

SEQ ID NO: 19290 - RNA, 630 nt, synthetic construct
  misc_feature 1..630: note = derived and/or modified sequence opt2 from anti-HIV_4JKP_LightChain
  source 1..630: mol_type = other RNA
gagatcgtcctcacccagtcccccgccaccctctccctctcccccggcgagaccgccatcatctcctgccgcacctcccagtacggctccctcgcctggtaccagcagcgccccggccaggccccccgcctcgtcatctactccggctccacccgcgccgccggcatccccgaccgcttctccggctcccgctggggcgccgactacaacctctccatctccaacctcgagtccggcgacttcggcgtctactactgccagcagtacgagttcttcggccagggcaccaaggtccaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 19291 - RNA, 678 nt, synthetic construct
  misc_feature 1..678: note = derived and/or modified sequence opt2 from anti-HIV_3TNN_E-Chain
  source 1..678: mol_type = other RNA
gaggtccagctcgtcgagtccggcggcggcctcgtccagcccggcggctccctccgcctctcctgcgccgcctccggcttcaccttctccacctacgccatgtcctgggtccgccaggcccccggcaagggcctcgagtgggtctcctccatcaacaactccggccgcaacaccttctccgccgactccgtcaagggccgcttcaccatctcccgcgacaactccaagaacaccctcttcctcgtcatgaactccctccgcgccgaggacaccgccgtctactactgcgccaaggacctccgcctcggcggcggctccgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccac

SEQ ID NO: 19292 - RNA, 705 nt, synthetic construct
  misc_feature 1..705: note = derived and/or modified sequence opt2 from anti-HIV_3BQU_B-Chain
  source 1..705: mol_type = other RNA
cgcatcaccctcaaggagtccggcccccccctcgtcaagcccacccagaccctcaccctcacctgctccttctccggcttctccctctccgacttcggcgtcggcgtcggctggatccgccagccccccggcaaggccctcgagtggctcgccatcatctactccgacgacgacaagcgctactccccctccctcaacacccgcctcaccatcaccaaggacacctccaagaaccaggtcgtcctcgtcatgacccgcgtctcccccgtcgacaccgccacctacttctgcgcccaccgccgcggccccaccaccctcttcggcgtccccatcgcccgcggccccgtcaacgccatggacgtctggggccagggcatcaccgtcaccatctcctccacctccaccaagggcccctccgtcttccccctcgccccctcctccaagtccaccgccggcggcgccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacacctgcaacgtcaaccacaagccctccaacaccaaggtcgacaagcgcgtcgagcccaagtcctgc

SEQ ID NO: 19293 - RNA, 642 nt, synthetic construct
  misc_feature 1..642: note = derived and/or modified sequence opt2 from anti-HIV_3BQU_A-Chain
  source 1..642: mol_type = other RNA
gccctccagctcacccagtccccctcctccctctccgcctccgtcggcgaccgcatcaccatcacctgccgcgcctcccagggcgtcacctccgccctcgcctggtaccgccagaagcccggctcccccccccagctcctcatctacgacgcctcctccctcgagtccggcgtcccctcccgcttctccggctccggctccggcaccgagttcaccctcaccatctccaccctccgccccgaggacttcgccacctactactgccagcagctccacttctacccccacaccttcggcggcggcacccgcgtcgacgtccgccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgagtgcgaggtcacccaccagggcctctcctcccccgtcaccaagtccttcaaccgcggcgagtgc

SEQ ID NO: 19294 - RNA, 387 nt, synthetic construct
  misc_feature 1..387: note = derived and/or modified sequence opt2 from anti-HIV_IgG_VR-Chain
  source 1..387: mol_type = other RNA
atggagacccccgcccagctcctcttcctcctcctcctctggctccccgacaccaccggcgagatcgtcctcacccagtcccccggcaccctctccctctccgccggcgagcgcgccaccctctcctgccgcgcctcccagtccgtctcctcccgctacctcgcctggtaccagcagaagcccggccaggccccccgcctcctcatctacggcgcctcctcccgcgccaccggcatccccgaccgcttctccggctccggctccggcaccgacttcaccctcaccatctcccgcgtcgagcccgaggacttcgccggctactactgccagcagtacgacaactccgtctgcaccttcggccagggcaccaagctcgagatcaagcgc

SEQ ID NO: 19295 - RNA, 348 nt, synthetic construct
  misc_feature 1..348: note = derived and/or modified sequence opt2 from anti-HIV_IgG_HeavyChain
  source 1..348: mol_type = other RNA
atgaagcacctctggttcttcctcctcctcgtcgccgccccccgctgggtcctctcccaggtccagctccaggagtccggccccggcctcgtcaagccctccgagaccctctccctcacctgcaccgtctccggcggctccatctcctcccactactggtcctggatccgccagtcccccggcaagggcctccagtggatcggctacatctactactccggctccaccaactactccccctccctcaagtcccgcgtcaccatctccgtcgagacctccaagaaccagttctccctcaagctcacctccatgaccgccgccgacaccgccgtctactactgcgcccgc

SEQ ID NO: 19296 - RNA, 714 nt, synthetic construct
  misc_feature 1..714: note = derived and/or modified sequence opt2 from anti-HIV_4P9M_HeavyChain
  source 1..714: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgacaagtggtccggcctccaccacgacggcgtcatggccttctcctcctggggccagggcaccctcatctccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacc

SEQ ID NO: 19297 - RNA, 645 nt, synthetic construct
  misc_feature 1..645: note = derived and/or modified sequence opt2 from anti-HIV_4P9M_LightChain
  source 1..645: mol_type = other RNA
gacatccagatgacccagtccccctccaccctctccgcctccatcggcgacaccgtccgcatctcctgccgcgcctcccagtccatcaccggcaactgggtcgcctggtaccagcagcgccccggcaaggccccccgcctcctcatctaccgcggcgccgccctcctcggcggcgtcccctcccgcttctccggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 19298 - RNA, 558 nt, synthetic construct
  misc_feature 1..558: note = derived and/or modified sequence opt2 from anti-HIV_4P9H_C-Chain
  source 1..558: mol_type = other RNA
aagaaggtcgtcctcggcaagaagggcgacaccgtcgagctcacctgcaccgcctcccagaagaagtccatccagttccactggaagaactccaaccagatcaagatcctcggcaaccagggctccttcctcaccaagggcccctccaagctcaacgaccgcgccgactcccgccgctccctctgggaccagggcaacttccccctcatcatcaagaacctcaccatcgaggactccgacacctacatctgcgaggtcgaggaccagaaggaggaggtccagctcctcgtcttcggcctcaccgccaactccgacacccacctcctccagggccagtccctcaccctcaccctcgagtccccccccggctcctccccctccgtccagtgccgctccccccgcggcaagaacatccagggcggcaagaccctctccgtctcccagctcgagctccaggactccggcacctggacctgcaccgtcctccagaaccagaagaaggtcgagttcaagatcgacatcgtcgtcctcgccttccagaaggccatcgacggccgc

SEQ ID NO: 19299 - RNA, 462 nt, synthetic construct
  misc_feature 1..462: note = derived and/or modified sequence opt2 from anti-HIV_4YBL_A-Chain
  source 1..462: mol_type = other RNA
gtccccgtctggaaggacgccgacaccaccctcttctgcgcctccgacgccaaggcccacgagaccgagtgccacaacgtctgggccacccacgcctgcgtccccaccgaccccaacccccaggagatccacctcgagaacgtcaccgagaacttcaacatgtggaagaacaacatggtcgagcagatgcaggaggacgtcatctccctctgggaccagtgcctccagcccggcggcgcccccaagatctccttcgaccccatccccatccactactgcacccccgccggctacgtcatcctcaagtgcaacgacaagaacttcaacggcaccggcccctgcaagaacgtctcctccgtccagtgcacccacggcatcaagcccgtcgtctcctccggcggcggcaacatcaaggacaactggcgctccgagctctacaagtacaaggtcgtccagatcgag

SEQ ID NO: 19300 - RNA, 1056 nt, synthetic construct
  misc_feature 1..1056: note = derived and/or modified sequence opt2 from anti-HIV_4R4N_V-Chain
  source 1..1056: mol_type = other RNA
atctggaaggacgccaacaccaccctcttctgcgcctccgacgccaaggcctacgacaccgaggtccacaacgtctgggccacccacgcctgcgtccccaccgacccctccccccaggagctcaagatggagaacgtcaccgaggagttcaacatgtggaagaacaacatggtcgagcagatgcacaccgacatcatctccctctgggaccagtccctcaagccctgcgtccagctcaccggcggctccgccctcacccaggcctgccccaaggtcaccttcgagcccatccccatccactactgcgcccccgccggctacgccatcctcaagtgcaacgacaaggagttcaacggcaccggcctctgcaagaacgtctccaccgtccagtgcacccacggcatccgccccgtcgtctccacccagctcctcctcaacggctccctcgccgagggcaaggtcatgatccgctccgagaacatcaccaacaacgtcaagaacatcatcgtccagctcaacgagtccgtcaccatcaactgcacccgccccaacaacggcggctccggctccggcggcgacatccgccaggcccactgcaacgtctccggctcccagtggaacaagaccctccaccaggtcgtcgagcagctccgcaagtactggaacaacaacaccatcatcttcaactcctcctccggcggcgacctcgagatcaccacccactccttcaactgcggcggcgagttcttctactgcaacacctccggcctcttcaactccacctgggtcaacggcaccgcctccatcgagaacggcaccatcaccctcccctgccgcatcaagcagatcatcaacatgtggcagcgcgtcggccaggccatctacgccccccccatccagggcgtcatccgctgcgtctccaacatcaccggcctcatcctcacccgcgacggcggcggcaactccaacgagaacgagaccttccgccccggcggcggcgacatgcgcgacaactggcgctccgagctctacaagtacaaggtcgtcaagatcgag

SEQ ID NO: 19301 - RNA, 1065 nt, synthetic construct
  misc_feature 1..1065: note = derived and/or modified sequence opt2 from anti-HIV_4JKP_G-Chain
  source 1..1065: mol_type = other RNA
gtctggaaggacgccgacaccaccctcttctgcgcctccgacgccaaggcccacgagaccgagtgccacaacgtctgggccacccacgcctgcgtccccaccgaccccaacccccaggagatccacctcgagaacgtcaccgagaacttcaacatgtggaagaacaacatggtcgagcagatgcaggaggacgtcatctccctctgggaccagtgcctccagccctgcgtcaagctcaccggcggctccgtcatcaagcaggcctgccccaagatctccttcgaccccatccccatccactactgcacccccgccggctacgtcatcctcaagtgcaacgacaagaacttcaacggcaccggcccctgcaagaacgtctcctccgtccagtgcacccacggcatcaagcccgtcgtctccacccagctcctcctcaacggctccctcgccgaggaggagatcatcatccgctccgagaacctcaccaacaacgccaagaccatcatcgtccacctcaacaagtccgtcgagatcaactgcacccgcccctccaacggcggctccggctccggcggcgacatccgcaaggcctactgcgagatcaacggcaccaagtggaacaaggtcctcaagcaggtcaccgagaagctcaaggagcacttcaacaacaagaccatcatcttccagcccccctccggcggcgacctcgagatcaccatgcaccacttcaactgccgcggcgagttcttctactgcaacaccacccagctcttcaacaacacctgcatcggcaacgagaccatgaagggctgcaacggcaccatcaccctcccctgcaagatcaagcagatcatcaacatgtggcagggcaccggccaggccatgtacgccccccccatcgacggcaagatcaactgcgtctccaacatcaccggcatcctcctcacccgcgacggcggcgccaacaacacctccaacgagaccttccgccccggcggcggcaacatcaaggacaactggcgctccgagctctacaagtacaaggtcgtccagatcgagggctcc

SEQ ID NO: 19302 - RNA, 723 nt, synthetic construct
  misc_feature 1..723: note = derived and/or modified sequence opt2 from anti-HIV_3BQU_D-Chain
  source 1..723: mol_type = other RNA
atgggctggtcctggatcttcctcttcctcctctccggcaccgccggcgtccactccggcgtccagctccagcagtccggccccgagctcgtcaagcccggcgcctccgtcaagatgtcctgcaaggcctccggctactccttcaccgactacttcatgcactgggtcaagcagtcccacggcaagtccctcgactggatcggctacatcaactgctacaccggcgccaccaactactcccagaagttcaagggcaaggccaccttcaccgtcgacacctcctccaacaccgcctacatgcagttcaactccctcacctccgaggactccgccgtctactactgcgcccgcacctccatcggctacggctcctccccccccttcccctactggggccagggcaccctcgtcaccgtctccgccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccccccgcccctccgagaccgtcacctgcaacgtcgcccaccccgcctcctccaccaaggtcgacaagaagatcgtcccccgc

SEQ ID NO: 19303 - RNA, 699 nt, synthetic construct
  misc_feature 1..699: note = derived and/or modified sequence opt2 from anti-HIV_3BQU_C-Chain
  source 1..699: mol_type = other RNA
atgaccatgttctccctcgccctcctcctctccctcctcctcctctgcgtctccgactccggcgccgagaccaccgtcacccagtcccccgcctccctctccatgtccatcggcgagaaggtcaccatccgctgcatcacctccaccgacatcgacgacgacatgaactggtaccagcagaagcccggcgagcccccccgcctcctcatctccgacggcaacaccctccgccccggcgtcccctcccgcttctcctcctccggctacggcaccgacttcgtcttcaccatcgagaacatgctctccgaggacgtcgccgactactactgcctccagtccgacaacctcccctacaccttcggcggcggcaccaacctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgc

SEQ ID NO: 19304 - RNA, 333 nt, synthetic construct
  misc_feature 1..333: note = derived and/or modified sequence opt2 from anti-HIV_Ig_LightChain
  source 1..333: mol_type = other RNA
gacgtcgtcctcacccagtcccccgcctccctcgccgtctccctcggccagcgcgccaccatctcctgcaaggcctcccagtccgtcgactacgacggcgactcctacatgaactggtaccagcagaagcccggccagccccccaagctcctcatccacgccgcctccaacctcgtctccggcatgcccgcccgcttctccggctccggctccggcaccgacttcaccctcaacatccaccccgtcgaggaggaggacgccgccacctactactgccagcagtccatcgaggacccccccaccttcggcggcggcaccaagctcgagatcaag

SEQ ID NO: 19305 - RNA, 342 nt, synthetic construct
  misc_feature 1..342: note = derived and/or modified sequence opt2 from anti-HIV_Ig_HeavyChain
  source 1..342: mol_type = other RNA
gacgtccagctccagcagtccggccccggcctcgtcaagccctcccagtccctctcccacacctgcaccgtcaccggctactccatcacctccgactacgcctggaactggatccgccagttccccggcaacaagctcgagtggatgggctacatctccttctccggctccacctcctacaacccctccctcaagtcccgcatctccatcacccgcgacacctccaagaacctcttcttcctccagctcaactccgtcaccaccgaggacaccgccacctactactgcgcccgcggcctccccgactactggggccagggcaccaccctcaccgtctcctcc

SEQ ID NO: 19306 - RNA, 1083 nt, synthetic construct
  misc_feature 1..1083: note = derived and/or modified sequence opt2 from anti-HIV_4P9H_G-Chain
  source 1..1083: mol_type = other RNA
gtctggaaggacgccgacaccaccctcttctgcgcctccgacgccaaggcccacgagaccgagtgccacaacgtctgggccacccacgcctgcgtccccaccgaccccaacccccaggagatccacctcgagcaggtcaccgagaacttcaacatgtggaagaacaacatggtcgagcagatgcaggaggacgtcatctccctctgggaccagtgcctccagccctgcgtcaagctcaccggcggctccgtcatcaagcaggcctgccccaagatctccttcgaccccatccccatccactactgcacccccgccggctacgtcatcctcaagtgcaacgacaagaacttcaacggcaccggcccctgcaagaacgtctcctccgtccagtgcacccacggcatcaagcccgtcgtctccacccagctcctcctcaacggctccctcgccgaggaggagatcatcatccgctccgagaacctcaccaacaacgccaagaccatcatcgtccacctccagaagtccgtcgagatcaactgcacccgcccctccaacggcggctccggctccggcggcgacatccgcaaggcctactgcgagatccagggcaccaagtggaacaaggtcctcaagcaggtcaccgagaagctcaaggagcacttcaacaacaagaccatcatcttccagcccccctccggcggcgacctcgagatcaccatgcaccacttcaactgccgcggcgagttcttctactgcaacaccacccagctcttccagaacacctgcatcggcaacgagaccatgaagggctgcaacggcaccatcaccctcccctgcaagatcaagcagatcatcaacatgtggcagggcaccggccaggccatgtacgccccccccatcgacggcaagatcaactgcgtctcccagatcaccggcatcctcctcacccgcgacggcggcgccaacaacacctccaacgagaccttccgccccggcggcggcaacatcaaggacaactggcgctccgagctctacaagtacaaggtcgtccagatcgagggctcccaccaccaccaccaccac

SEQ ID NO: 19307 - RNA, 147 nt, synthetic construct
  misc_feature 1..147: note = derived and/or modified sequence opt2 from anti-HIV_Chain
  source 1..147: mol_type = other RNA
caggtccagctcgtccagtccggcggccagatgaagaagcccggcgagtccatgcgcatctcctgccgcgcctccggctacgagttcatcgactgcaccctcaactggatccgcctcgcccccggcaagcgccccgagtggatgggc

SEQ ID NO: 19308 - RNA, 180 nt, synthetic construct
  misc_feature 1..180: note = derived and/or modified sequence opt2 from anti-HIV_Chain
  source 1..180: mol_type = other RNA
ccctgctgcttcgcctacatcgcccgccccctcccccgcgcccacatcaaggagtacttctacacctccggcaagtgctccaaccccgccgtcgtcttcgtcacccgcaagaaccgccaggtctgcgccaaccccgagaagaagtgggtccgcgagtacatcaactccctcgagatgtcc

SEQ ID NO: 19309 - RNA, 249 nt, synthetic construct
  misc_feature 1..249: note = derived and/or modified sequence opt2 from anti-HIV_Chain
  source 1..249: mol_type = other RNA
ctcgagtggatgggccgcatcatccccgccatcgacgacgtcacctacgcccagaccttccgcggccgcgtcaccttctccgccgacaagttcaccaccaccgcctacatggacctcaccggcctccgctccgaggacaccgccacctacttctgcgcccgcgacccccaggtcaaccgccgcggcaactgcttcgaccactggggccagggcaccctcgtcaccgtctcctccgcctccaccaagggc

SEQ ID NO: 19310 - RNA, 270 nt, synthetic construct
  misc_feature 1..270: note = derived and/or modified sequence opt2 from anti-HIV_Chain
  source 1..270: mol_type = other RNA
gacgtcgtcatgacccagtcccccctctccctccccgtcaccctcggccagcccgcctccatctcctgccgctcctcccagtccctcgtctactcccacggcgacacctacctcaagtgcttccagcagcgccccggccagtccccccgccgccccatctacaaggtctccaaccgcgactccggcgtccccgaccgcttctccggctccggctccggcaccgacttcaccctcaagatctcccgcgtcgaggccgaggacgtcggcgtc

SEQ ID NO: 19311 - RNA, 294 nt, synthetic construct
  misc_feature 1..294: note = derived and/or modified sequence opt2 from anti-HIV_Chain
  source 1..294: mol_type = other RNA
tcctccttcgccatctcctgggtccgccaggcccccggccagggcctcgagtggatgggcggcatcatccccatcttcgaggccacctcctacgcccagaagttccaggaccgcctcaccatcaccaccgacgagtccaccaccaccgcctacatggacctctcctccctccgctccgaggacaccgccgtctactactgcgcccgcgcccagggcgacatcctcaccgagggctacttcgactactggggccagggcaccctcgtcaccgtctcctccgcctccaccaagggc

SEQ ID NO: 19312 - RNA, 297 nt, synthetic construct
  misc_feature 1..297: note = derived and/or modified sequence opt2 from anti-HIV_Chain
  source 1..297: mol_type = other RNA
aacaccttcacctcccactacgtccactgggtccgccaggcccccggccagggcctcgagtggatgggcatgatcaaccccggcggcaccacccgctacgcccccaagttccaggaccgcgtcaccctcacccgcgacacctccacccgcaccgtctacatggagctccgctccctccgctccgaggacaccgccgtctactactgcgcccgcccccagtacaacctcggccgcgagcccctcaacgtctggggccagggcaccatggtcaccgtctcctccgcctccaccaagggc

SEQ ID NO: 19313 - RNA, 297 nt, synthetic construct
  misc_feature 1..297: note = derived and/or modified sequence opt2 from anti-HIV_Chain
  source 1..297: mol_type = other RNA
atccgctccttctactggcactggatccgccagtcccccggcaagggcctcgagtggctcggctccgtcttcgacaacggcctcaccacccacaacccctccctcaagtcccgcctcaccatctccgaggacccctcccgcaaccagatctccctcaagctccgctccatgaccgccgccgacaccgccgtctactactgcgcccgcggcgactacgacatcctcacctcctcctaccagttcgactactggggccagggcaccctcgtcgccgtctcctccgcctccaccaagggc

SEQ ID NO: 19314 - RNA, 300 nt, synthetic construct
  misc_feature 1..300: note = derived and/or modified sequence opt2 from anti-HIV_Chain
  source 1..300: mol_type = other RNA
cagtccgccctcacccagcccgccttcgtctccggctcccccggccagtccatcaccctctcctgcaccctcggcaccgaggacgtctcctggtaccagcagcgccccaactccgccccccgcctcatcatcttcgacgtcaagaagcgcccctccgacgtctccgaccgcttctccggccacaactccgacaccgccgccttcctcaccatctccgagctccgccccgaggacgaggccgactacttctgcacctcctggccctaccgcttcgaccgcggcaccaaggtcgacgtcgcc

SEQ ID NO: 19315 - RNA, 300 nt, synthetic construct
  misc_feature 1..300: note = derived and/or modified sequence opt2 from anti-HIV_Chain
  source 1..300: mol_type = other RNA
cagtccgccctcacccagcccgccttcgtctccggctcccccggccagtccatcaccctctcctgcaccctcggcaccgaggacgtctcctggtaccagcagcgccccaactccgccccccgcctcatcatcttcgacgtcaagaagcgcccctccgacgtctccgaccgcttctccggccacaactccgacaccgccgccttcctcaccatctccgagctccgccccgaggacgaggccgagtacttctgcacctcctggccctaccgcttcggccgcggcaccaaggtcgacgtcgcc

SEQ ID NO: 19316 - RNA, 300 nt, synthetic construct
  misc_feature 1..300: note = derived and/or modified sequence opt2 from anti-HIV_Chain
  source 1..300: mol_type = other RNA
cagtccgccctcacccaccccgccttcgtctccggctcccccggccagtccatcaccctctcctgcaccctcggcaccgaggacgtctcctggtaccagcagcgccccaactccgccccccgcctcatcatcttcgacgtccgcaagcgcccctccgaggtctccgaccgcttctccggccacaagtccgacaccgccgccttcctcaccatctccgacctccgccccgaggacgaggccgagtacttctgcacctcctggccctaccgcttcgaccgcggcacccgcctcgacgtcgcc

SEQ ID NO: 19317 - RNA, 300 nt, synthetic construct
  misc_feature 1..300: note = derived and/or modified sequence opt2 from anti-HIV_Chain
  source 1..300: mol_type = other RNA
cagtccgtcctcacccagcccgccttcgtctccggctcccccggccagtccatcaccatctcctgcaccgtcggcaccaccgacgtctcctggtaccagcagcgccccaactccgccccccgcctcatcatcttcgacgtcaagaagcgcccctccggcgtctccgaccgcttctccggctcctcctccgacaacgccgccttcctcaccatcgccggcctccgccccgaggacgaggccgagtactactgcacctcctggccctaccgcttcggccgcggcaccaaggtcgacgtcggc

SEQ ID NO: 19318 - RNA, 300 nt, synthetic construct
  misc_feature 1..300: note = derived and/or modified sequence opt2 from anti-HIV_Chain
  source 1..300: mol_type = other RNA
cagtccgtcctcacccagcccgccttcgtctccgcctcccccggccagtccatcaccctctcctgcaacctcggcaccgactacgtctcctggtaccagcagcgcccctcctccgccccccgcctcatcatcttcgacgtcaagaaccgcccctccggcgtctccgaccgcttctccggctacaactccgacaccgccgccttcctcaccatctccggcctccagcccgaggacgaggccgagtactactgcacctcctggccctacaacttcggccccggcaccaaggtcgacgtcacc

SEQ ID NO: 19319 - RNA, 300 nt, synthetic construct
  misc_feature 1..300: note = derived and/or modified sequence opt2 from anti-HIV_Chain
  source 1..300: mol_type = other RNA
cagtccgtcctcacccagcccgcctccgtctccggctcccccggccagtccatcaacatctcctgcgccggccgctccgaccgcgtctcctggtaccagcagcgccccaacggcgtccccaagctcctcctcttcgacgtctaccgccgcccctccggcgtctccgaccgcttctccggctcccactccgacgacaccgccttcctcaccatctccggcctccagaccgacgacgaggccgactactactgcacctcccacccctacgccttcggccccggcaccaaggtcaacgtcctc

SEQ ID NO: 19320 - RNA, 300 nt, synthetic construct
  misc_feature 1..300: note = derived and/or modified sequence opt2 from anti-HIV_Chain
  source 1..300: mol_type = other RNA
cagtccgtcctcacccagcccgccttcgtctccggctcccccggccagtccatcaccctctcctgcaccctcggcaccgaggacgtctcctggtaccagcagcgccccaactccgccccccgcctcatcatcttcgacgtcaagaagcgcccctccgacgtctccgaccgcttctccggccacaactccgacaccgccgccttcctcaccatctccgagctccgccccgaggacgaggccgagtacttctgcacctcctggccctaccgcttcggccgcggcaccaaggtcgacgtcgcc

SEQ ID NO: 19321 - RNA, 306 nt, synthetic construct
  misc_feature 1..306: note = derived and/or modified sequence opt2 from anti-HIV_Chain
  source 1..306: mol_type = other RNA
cagtccgccctcacccagcccgcctccgtctccggctcccccggccagtccatcaccatctcctgcaccgccgactccgactacgtctcctggtaccagcagcgccccaactccgcccccaagctcatcctcttcgacgtcaactcccgcccctccggcgtctccgaccgctactccggctcccgctccggcaacaccgcctccctcaccatctccggcctccagcgcgaggacgaggccgactacttctgcaccccctggccctacgacttccgccccggcacccgcgtcttcgtcctcggccag

SEQ ID NO: 19322 - RNA, 306 nt, synthetic construct
  misc_feature 1..306: note = derived and/or modified sequence opt2 from anti-HIV_Chain
  source 1..306: mol_type = other RNA
cagtccgccctcacccagcccgccttcgtctccggctcccccggccagtccatcaccctctcctgctccctcggcaccgccgacgtctcctggtaccagcagcgccccaactccgccccccgcctcatcatcttcgacgtcaagaagcgcccctccgacgtctccgaccgcttctccggccacaactccgacaccgccgccttcgtcaccatctccgagctccgccccgaggacgaggccgagtacttctgcacctcctggccctaccgcttcggccccggcaccaaggtcgacgtcgcccgccag

SEQ ID NO: 19323 - RNA, 306 nt, synthetic construct
  misc_feature 1..306: note = derived and/or modified sequence opt2 from anti-HIV_Chain
  source 1..306: mol_type = other RNA
cagtccgtcctcacccagcccgcctccgtctccggctcccccggccagaccatctccatctcctgctccggcaccttcggctccgactccgtctcctggtaccagcagttccccaactccgcccccaccctcatcatcttcgacgtccaccgccgcccctccggcatctccacccgcttctccggctccacctccggcgacaccgcctccctcaccatctccaccctccaccgcgaggacgaggccttctactactgcacctcccacccctacgacttcggcggcggcacctacgtcatcgtcctc

SEQ ID NO: 19324 - RNA, 306 nt, synthetic construct
  misc_feature 1..306: note = derived and/or modified sequence opt2 from anti-HIV_Chain
  source 1..306: mol_type = other RNA
cagtccgtcctcacccagcccgcctccgtctccggctcccccggccagaccatctccatctcctgctccggcaccttcggctccgactccgtctcctggtaccagcagtaccccaactccgcccccaccctcatcatcttcgacgtccaccgccgcccctccggcatctccacccgcttctccggctccacctccggcgacaccgcctccctcaccatctccaccctccaccgcgaggacgaggcctactactactgcacctcccacccctacgacttcggcggcggcacctacgtcatcgtcctc

SEQ ID NO: 19325 - RNA, 306 nt, synthetic construct
  misc_feature 1..306: note = derived and/or modified sequence opt2 from anti-HIV_Chain
  source 1..306: mol_type = other RNA
cagtccgccctcacccagcccgcctccgtctccggctcccccggccagtccatcaacatctcctgcgccggccgctccgaccgcgtctcctggtaccagcagcgccccaacggcgtccccaagctcctcatgttcgacgtctaccgccgcccctccggcgtctccgaccgcttctccggctcccactccggcgacaccgccttcctcaccatctccggcctccagaccgaggacgaggccgactactactgcacctcccacccctacgccttcggcgccggcaccaaggtcaacgtcctccgccag

SEQ ID NO: 19326 - RNA, 306 nt, synthetic construct
  misc_feature 1..306: note = derived and/or modified sequence opt2 from anti-HIV_Chain
  source 1..306: mol_type = other RNA
gacatccagatgacccagtccccctcctccctctccgcctccgtcggcgaccgcgtctccatccactgccaggccggccagggcatcggctcctccctcaactggtaccagcagaagcccggccgcgccccccgcctcctcgtccacggcgcctccaacctccagcgcggcgtcccctcccgcttctccggctccggcttccacaccaccttcaccctcaccatctcctccctccagcccgacgacgtcgccacctactggtgcgccgccctcgagttcttcggccccggcaccaaggtcgagatc

SEQ ID NO: 19327 - RNA, 309 nt, synthetic construct
  misc_feature 1..309: note = derived and/or modified sequence opt2 from anti-HIV_Chain
  source 1..309: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgtcgtccccggcacccgcctcgacctcaagcgcaccgtcgcc

SEQ ID NO: 19328 - RNA, 309 nt, synthetic construct
  misc_feature 1..309: note = derived and/or modified sequence opt2 from anti-HIV_Chain
  source 1..309: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagcgcggcgtccccgcccgcttctccggccgccgctggggccaggagtacaacctcaccatcaacaacctccagcccgaggacgtcgccacctacttctgccaggtctacgagttcatcgtccccggcacccgcctcgacctcaagcgcaccgtcgcc

SEQ ID NO: 19329 - RNA, 309 nt, synthetic construct
  misc_feature 1..309: note = derived and/or modified sequence opt2 from anti-HIV_Chain
  source 1..309: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgccgtccccggcacccgcctcgacctcaagcgcaccgtcgcc

SEQ ID NO: 19330 - RNA, 309 nt, synthetic construct
  misc_feature 1..309: note = derived and/or modified sequence opt2 from anti-HIV_Chain
  source 1..309: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccaggccgaggacatcgccacctacttctgccaggtctacgagttcgccgtccccggcacccgcctcgacctcaagcgcaccgtcgcc

SEQ ID NO: 19331 - RNA, 309 nt, synthetic construct
  misc_feature 1..309: note = derived and/or modified sequence opt2 from anti-HIV_Chain
  source 1..309: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcatcgtccccggcacccgcctcgacctcaagcgcaccgtcgcc

SEQ ID NO: 19332 - RNA, 309 nt, synthetic construct
  misc_feature 1..309: note = derived and/or modified sequence opt2 from anti-HIV_Chain
  source 1..309: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagaccggcgtcccctcccgcttcaccggccgccgctggggccaggagtacaacctcaccatcaacaacctccagcccgaggacatcgccacctacttctgccaggtctacgagttcatcgtccccggcacccgcctcgacctcaagcgcaccgtcgcc

SEQ ID NO: 19333 - RNA, 312 nt, synthetic construct
  misc_feature 1..312: note = derived and/or modified sequence opt2 from anti-HIV_Chain
  source 1..312: mol_type = other RNA
gacatccagatgacccagtccccctcctccctctccgcctccgtcggcgacaaggtcaccatcacctgccagacctccgccggctacctcaactggtaccagcagcgccgcggccgcgcccccaagctcctcatgtacgacggctcccgcctcgtcaccggcgtcccctcccgcttctccggccgccgctggggcacccagtacaacctcaccatcggctccctccagcccgaggacgtcgccacctactactgccaggtctacgagttcttcggccccggcacccgcctcgacctcaagcgcaccgtcgcc

SEQ ID NO: 19334 - RNA, 312 nt, synthetic construct
  misc_feature 1..312: note = derived and/or modified sequence opt2 from anti-HIV_Chain
  source 1..312: mol_type = other RNA
gacatccagatgacccagtccccctcctccctctccgcctccgtcggcgacaaggtcaccatcacctgccagacctccgccggctacctcaactggtaccagcagcgccgcggccgcgcccccaagctcctcatgtacgacggctcccgcctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagtccaccgtcgcc

SEQ ID NO: 19335 - RNA, 312 nt, synthetic construct
  misc_feature 1..312: note = derived and/or modified sequence opt2 from anti-HIV_Chain
  source 1..312: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagcgcggcgtccccgcccgcttctccggccgccgctggggccaggagtacaacctcaccatcaacaacctccagcccgaggacgtcgccacctacttctgccaggtctacgagttcatcgtccccggcacccgcctcgacctcaagcgcaccgtcgccgcc

SEQ ID NO: 19336 - RNA, 312 nt, synthetic construct
  misc_feature 1..312: note = derived and/or modified sequence opt2 from anti-HIV_Chain
  source 1..312: mol_type = other RNA
tgcaccgtctccggcggctccatcatctcctactactggaactggatccgccagtcccccggcaagggcctcgagtggctcggctacatcttcgacggcggccgcgccaactacaacccctccctccgctcccgcctcaccatgtccgtcgacacctccaagaaccagatctccctcaaggtcaagtccgtcaccgccgccgactccgccatctactactgcgcccgcctcgacggcgaggccttccgctactacttcgactcctggggccagggcaccctcgtcaccgtctcctccgcctccaccaagggc

SEQ ID NO: 19337 - RNA, 312 nt, synthetic construct
  misc_feature 1..312: note = derived and/or modified sequence opt2 from anti-HIV_Chain
  source 1..312: mol_type = other RNA
gtctccggcggccgcttctccaactacggcctctcctgggtccgccaggcccccggccagggcctcgagtggatgggccgcatcgtccccgccatcaaccgcgccaagtacgcccagaagttccagggccgcgtcatcctcaccgccgacaagatcaccgacaccgcctacatggagctccgctccctccgctccgaggacaccgccatcttctactgcgcccgcgacccccagatcgagatccgcggcaacgccttcgacatctggggccagggcaccgtcgtcaccgtctcctccgcctccaccaagggc

SEQ ID NO: 19338 - RNA, 315 nt, synthetic construct
  misc_feature 1..315: note = derived and/or modified sequence opt2 from anti-HIV_Chain
  source 1..315: mol_type = other RNA
tccgacatctccgtcgcccccggcgagaccgcccgcatctcctgcggcgagaagtccctcggctcccgcgccgtccagtggtaccagcaccgcgccggccaggccccctccctcatcatctacaacaaccaggaccgcccctccggcatccccgagcgcttctccggctcccccgactcccccttcggcaccaccgccaccctcaccatcacctccgtcgaggccggcgacgaggccgactactactgccacatctgggactcccgcgtccccaccaagtgggtcttcggcggcggcaccaccctcaccgtcctc

SEQ ID NO: 19339 - RNA, 315 nt, synthetic construct
  misc_feature 1..315: note = derived and/or modified sequence opt2 from anti-HIV_Chain
  source 1..315: mol_type = other RNA
tcctccatgtccgtctcccccggcgagaccgccaagatctcctgcggcaaggagtccatcggctcccgcgccgtccagtggtaccagcagaagtccggccagcccccctccctcatcatctacaacaaccaggaccgcccctccggcgtccccgagcgcttctccgccacccccgacttcggcgccggcaccaccgccaccctcaccatcaccaacgtcgaggccgacgacgaggccgactactactgccacatctacgacgcccgcggcggcaccaactgggtcttcgaccgcggcgccaccctcaccgtcctc

SEQ ID NO: 19340 - RNA, 315 nt, synthetic construct
  misc_feature 1..315: note = derived and/or modified sequence opt2 from anti-HIV_Chain
  source 1..315: mol_type = other RNA
tccttcgtctccgtcgcccccggccagaccgcccgcatcacctgcggcgaggagtccctcggctcccgctccgtcatctggtaccagcagcgccccggccaggccccctccctcatcatctacaacaacaacgaccgcccctccggcatccccgagcgcttctccggctcccccggctccaccttcggcaccaccgccaccctcaccatcacctccgtcgaggccggcgacgaggccgactactactgccacatctgggactcccgccgccccaccaactgggtcttcggcgagggcaccaccctcaccgtcctc

SEQ ID NO: 19341 - RNA, 315 nt, synthetic construct
  misc_feature 1..315: note = derived and/or modified sequence opt2 from anti-HIV_Chain
  source 1..315: mol_type = other RNA
tccttcgtctccgtcgcccccggccagaccgcccgcatcacctgcggcgaggagtccctcggctcccgctccgtcatctggtaccagcagcgccccggccaggccccctccctcatcatgtacaacaaccacgaccgcccctccggcatccccgagcgcttctccggctcccccggctccaccttcggcaccaccgccaccctcaccatcacctccgtcgaggccggcgacgaggccgactactactgccacatctgggactcccgccgccccaccaactgggtcttcggcgagggcaccaccctcaccgtcctc

SEQ ID NO: 19342 - RNA, 315 nt, synthetic construct
  misc_feature 1..315: note = derived and/or modified sequence opt2 from anti-HIV_Chain
  source 1..315: mol_type = other RNA
gacatccagatgacccagtccccctcctccctctccgcctccgtcggcgacaaggtcaccatcacctgccagacctccgccggctacctcaactggtaccagcagcgccgcggccgcgcccccaagctcctcatgtacgacggctcccgcctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagtccaccgtcgccgcc

SEQ ID NO: 19343 - RNA, 315 nt, synthetic construct
  misc_feature 1..315: note = derived and/or modified sequence opt2 from anti-HIV_Chain
  source 1..315: mol_type = other RNA
gacatccagatgacccagtccccctcctccctctccgcctccgtcggcgaccgcgtctccatcaactgccaggccggccagggcctcggctcctccctcaactggtaccagcagaagcccggccgcgcccccaagctcctcgtccacggcgcctccaacctccagcgcggcgtcccctcccgcttctccggctccggcttccacaccaccttcaccctcaccatctcctccctccagcccgacgacgtcgccacctacttctgcgccgccttccagtggttcggccccggcaccaaggtcgagatcaagcgcacc

SEQ ID NO: 19344 - RNA, 318 nt, synthetic construct
  misc_feature 1..318: note = derived and/or modified sequence opt2 from anti-HIV_Chain
  source 1..318: mol_type = other RNA
tgcaccgtctccggcggctccatctcctccgccggctactactggacctggatccgccagcaccccggcaagggcctcgagttcatcggctacatctactacatcggcaccacctactacaacccctccctcaagtcccgcctcaccatctccatcgacacctccaagaaccagttctccctcaagctctcctccgtcaccgccgccgacaccgccatctactactgcgcccgcgactacaccgcccgcggccgccacttcttcgactactggggccagggcgccctcgtcaccgtctcctccgcctccaccaagggc

SEQ ID NO: 19345 - RNA, 321 nt, synthetic construct
  misc_feature 1..321: note = derived and/or modified sequence opt2 from anti-HIV_Chain
  source 1..321: mol_type = other RNA
tcctccctccccctctccctcgcccccggcgccaccgccaagatcccctgcggcgagaagtcccgcggctcccgcgccgtccagtggtaccagcagaagcccggccaggcccccaccctcatcatctacaacaaccaggaccgccccgccggcgtctccgagcgctactccggcaaccccgacgtcgccatcggcgtcaccgccaccctcaccatctcccgcgtcgaggccggcgacgaggccgagtactactgccactactgggactcccgctcccccatctcctgggtcttcggcggctggacccagctcaccgtcctc

SEQ ID NO: 19346 - RNA, 321 nt, synthetic construct
  misc_feature 1..321: note = derived and/or modified sequence opt2 from anti-HIV_Chain
  source 1..321: mol_type = other RNA
tcctccctccccctctccgtcgcccccggcgccaccgccaagatcgcctgcggcgagaagtccttcgcctcccgcgccgtccagtggtaccagcagaagcccggccaggcccccgtcctcatcatctacaacaaccaggaccgccccgccggcgtctccgagcgcttctccggcacccccgacgtcggcttcggctccaccgccaccctcaccatctcccgcgtcgaggccggcgacgaggccgactactactgccacaagtgggactcccgctcccccctctcctgggtcttcggcggcggcacccagctcaccgtcctc

SEQ ID NO: 19347 - RNA, 321 nt, synthetic construct
  misc_feature 1..321: note = derived and/or modified sequence opt2 from anti-HIV_Chain
  source 1..321: mol_type = other RNA
gacatccagatgacccagtccccctcctccctctccgcctccatcggcgaccgcgtcaccatcacctgccgcgcctcccaggacatcgccaactacctcaactggtaccagaagaagtccggcaccccccccaagctcctcatcttcgccgccaccaacctccaccgcggcgtctccccccgcttcaccggctccggccacggcacccacttctccctcaccatcaccaacgtccagcacgaggacttcggcaactacttctgccagcagtccttcgccaccgtcggctccttcggccagggcacctgggtcgacatccgc

SEQ ID NO: 19348 - RNA, 321 nt, synthetic construct
  misc_feature 1..321: note = derived and/or modified sequence opt2 from anti-HIV_Chain
  source 1..321: mol_type = other RNA
gacatccagatgacccagtccccctcctccctctccgcctccatcggcgaccgcgtcaccatcacctgccgcgcctcccaggacatcgccaactacctcaactggtaccagaagaagtccggcaccccccccaagctcctcatcttcgccgccaccaacctccaccgcggcgtctccccccgcttcaccggctccggccacggcacccacttctccctcaccatcaccaacgtccagcacgaggacttcggccactacttctgccagcagtccttcgccaccgtcggctccttcggccagggcacctgggtcgacatccgc

SEQ ID NO: 19349 - RNA, 321 nt, synthetic construct
  misc_feature 1..321: note = derived and/or modified sequence opt2 from anti-HIV_Chain
  source 1..321: mol_type = other RNA
gacatccagatgacccagtccccctcctccctctccgcctccgtcggcgaccgcgtcaccatcacctgccgcgcctcccaggacatcgccaactacctcaactggtaccagaagaagtccggcaccccccccaagctcctcatcttcgccgccaccaacctccaccgcggcgtctccccccgcttctccggctccggctccggcacccacttctccctcaccatcaccaacgtccagtacgaggacttcgccaactacttctgccagcactccttcggcaccatcggcaccttcggccagggcacctgggtcgacatccgc

SEQ ID NO: 19350 - RNA, 321 nt, synthetic construct
  misc_feature 1..321: note = derived and/or modified sequence opt2 from anti-HIV_Chain
  source 1..321: mol_type = other RNA
gacatccagatgacccagtccccctcctccctctccgcctccatcggcgaccgcgtcaccatcacctgccgcgcctcccaggacatcgccaactacctcaactggtaccagaagaagtccggcaccccccccaagctcctcatcttcggcgccaccaacctccaccacggcgtctccccccgcttctccggctccggccacggcacccacttctccctcaccatcaccaacgtccagcacgaggacttcgccaactacttctgccagcagtccttccagaccgtcggctccttcggccagggcacctgggtcgacatccgc

SEQ ID NO: 19351 - RNA, 321 nt, synthetic construct
  misc_feature 1..321: note = derived and/or modified sequence opt2 from anti-HIV_Chain
  source 1..321: mol_type = other RNA
gagatcgtcctcacccagtcccccgccaccctctccctctcccccggcgagaccgccatcatctcctgccgcacctcccagtccggctccctcgcctggtaccagcagcgccccggccaggccccccgcctcgtcatctactccggctccacccgcgccgccggcatccccgaccgcttctccggctcccgctggggcgccgactacaacctctccatctccaacctcgagtccggcgacttcggcgtctactactgccagcagtacgagttcttcggccagggcaccaaggtccaggtcgacatcaagcgcaccgtcgcc

SEQ ID NO: 19352 - RNA, 321 nt, synthetic construct
  misc_feature 1..321: note = derived and/or modified sequence opt2 from anti-HIV_Chain
  source 1..321: mol_type = other RNA
gacatccagatgacccagtccccctcctccctctccgcctccatcggcgaccgcgtcaacatcacctgccaggcctcccgcgacaccggctccgccctcaactggtaccagcagaaggtcggccgccccccccgcctcctcatctccgccgtctccaacctcggcgccggcgtcccctcccgcttctccggccgccgctccggcacccagtccaccctcaccatcaacaccctccagcccgaggacatcgccacctacttctgccagcactacgagttcttcggccccggcaccaaggtcgacatcaagcgcaccgtcgcc

SEQ ID NO: 19353 - RNA, 321 nt, synthetic construct
  misc_feature 1..321: note = derived and/or modified sequence opt2 from anti-HIV_Chain
  source 1..321: mol_type = other RNA
gacatccagatgacccagtccccctcctccctctccgcctccgtcggcgaccgcgtcaccatcacctgccaggccggccagggcatcggctcctccctccagtggtaccagcagaagcccggcaaggcccccaagctcctcgtccacggcgcctccaacctccaccgcggcgtcccctcccgcttctccggctccggcttccacaccaccttctccctcaccatctccggcctccagcgcgacgacttcgccacctacttctgcgccgtcctcgagttcttcggccccggcaccaaggtcgagatcaagcgcaccgtcgcc

SEQ ID NO: 19354 - RNA, 324 nt, synthetic construct
  misc_feature 1..324: note = derived and/or modified sequence opt2 from anti-HIV_Chain
  source 1..324: mol_type = other RNA
tcctacgtccgccccctctccgtcgccctcggcgagaccgcctccatctcctgcggccgccaggccctcggctcccgcgccgtccagtggtaccagcaccgccccggccaggcccccatcctcctcatctacaacaaccaggaccgcccctccggcatccccgagcgcttctccggcacccccgacatcaacttcggcacccgcgccaccctcaccatctccggcgtcgaggccggcgacgaggccgactactactgccacatgtgggactcccgctccggcttctcctggtccttcggcggcgccacccgcctcaccgtcctc

SEQ ID NO: 19355 - RNA, 324 nt, synthetic construct
  misc_feature 1..324: note = derived and/or modified sequence opt2 from anti-HIV_LightChain
  source 1..324: mol_type = other RNA
gacatcctcatgacccagtccccctccctcctctccgcctccgtcggcgaccgcgtcaccatcacctgcaaggcctcccaggacgtctccaccgccgtcgcctggtaccagcagaagcccggcaaggcccccaagctcctcatctactgggcctccacccgccacaccggcgtcccctcccgcttcaccggctccggctccggcaccgacttcaccctcaccatctcccgcctccaggccgaggacttcgccctctactactgccagcagcactacaccaccccctggaccttcggcggcggcaccaaggtcgagatcaagcgc

SEQ ID NO: 19356 - RNA, 324 nt, synthetic construct
  misc_feature 1..324: note = derived and/or modified sequence opt2 from anti-HIV_LightChain
  source 1..324: mol_type = other RNA
gacatcgtcatgacccagtccccctccctcctctccgcctccgtcggcgaccgcgtcaccatcacctgcaaggcctcccaggacgtctccaccgccgtcgcctggtaccagcagaagcccggcaaggcccccaagctcctcatctactgggcctccacccgccacaccggcgtcccctcccgcttctccggctccggctccggcaccgacttcaccctcaccatctcctccctccagcccgaggacttcgccctctactactgccagcagcactacaccaccccctggaccttcggcggcggcaccaaggtcgagatcaagcgc

SEQ ID NO: 19357 - RNA, 324 nt, synthetic construct
  misc_feature 1..324: note = derived and/or modified sequence opt2 from anti-HIV_Chain
  source 1..324: mol_type = other RNA
gacatccagatgacccagtccccctcctccctctccgcctccgtcggcgacaccgtcaccatcaactgccagaccaacaagggctacctcaactggtaccagcagcgccgcggccgcgcccccaagctcctcatgtacgacggctccaagctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgac

SEQ ID NO: 19358 - RNA, 333 nt, synthetic construct
  misc_feature 1..333: note = derived and/or modified sequence opt2 from anti-HIV_Chain
  source 1..333: mol_type = other RNA
ctctccgcctacgtcggcgaccgcgtcaccatcacctgccgcgcctcccagaacatcaacacctacctcaactggtaccagcagcgccccggcaaggcccccaagctcctcatctacgccgcctccaccctccagtccggcgtcccctcccgcttctccggctccggctccggcaccgacttcaccctcaccatctccaacctcgagaccgaggacttcgccgtctactactgccagcagacctactcctccgtcaccttcggccagggcaccaagctcgagacccgccgcaccgtcgccgccccctccgtcttcatcttccccccctccgac

SEQ ID NO: 19359 - RNA, 333 nt, synthetic construct
  misc_feature 1..333: note = derived and/or modified sequence opt2 from anti-HIV_Chain
  source 1..333: mol_type = other RNA
gagatcgtcctcacccagtcccccgccaccctctccctctcccccggcgagcgcgccaccctctcctgccgcgcctcccagggcgtcaacttcgtcgtctggtaccagcagaagcgcggccaggccccccgcctcctcatctacggcaactccgaccgcgtccccggcgtccccgaccgcttctccgcccgcggctccggcaccgagttctccctcgtcatctcctccgtcgagcccgacgacttcgccctctactactgccaggagtactcctccaccccctacaacttcggccccggcacccgcgtcgaccgcaagcgcaccgtcgccgcc

SEQ ID NO: 19360 - RNA, 336 nt, synthetic construct
  misc_feature 1..336: note = derived and/or modified sequence opt2 from anti-HIV_HeavyChain
  source 1..336: mol_type = other RNA
gaggtcaagctcgaggagtccggcggcggcctcgtccagcccggcggctcccgcaagctctcctgcgccgcctccggcttcaccttctcctccttcggcatgcactgggtccgccaggcccccgagaagggcctcgagtgggtcgcctacatctcctccggctcctccaccctccactacgccgacaccgtcaagggccgcttcaccatctcccgcgacaaccccaagaacaccctcttcctccagatgaagctcccctccctctgctacggcctcctcggctcccgcaacctctcccaccgcctcctctcccagaacgacacccccatctgcctc

SEQ ID NO: 19361 - RNA, 336 nt, synthetic construct
  misc_feature 1..336: note = derived and/or modified sequence opt2 from anti-HIV_Chain
  source 1..336: mol_type = other RNA
gagatcgtcctcacccagtcccccgccaccctctccctctcccccggcgagcgcgccaccctctcctgccgcgcctcccagggcgtcaacttcgtcgtctggtaccagcagaagcgcggccaggccccccgcctcctcatctacggcccctccgaccgcgcccccggcgtccccgaccgcttctccgcccgcggctccggcaccgagttctccctcgtcatctcctccgtcgagcccgacgacttcgccctctactactgccaggagtactcctccaccccctacaacttcggcaccggcacccgcgtcgaccgcaagcgcaccgtcgccgccccc

SEQ ID NO: 19362 - RNA, 336 nt, synthetic construct
  misc_feature 1..336: note = derived and/or modified sequence opt2 from anti-HIV_Chain
  source 1..336: mol_type = other RNA
cagaccctctccctcacctgctccgtctccggcggctccatctcctccgccggctactactggggctggatccgccagcaccccggcaagggcctcgagtggatcggccacatctactactccggcaacaccaactacaacccctccctcaagtcccgcctctccatgtccgtcgagacctccaagaaccagttctccctcaacctcgcctccgtcaccgccgccgacaccgccgtctacttctgcgcccgcgactactccgccgccggccgccacctcttcgactcctggggccagggcatcctcgtcaccgtctcctccgcctccaccaagggc

SEQ ID NO: 19363 - RNA, 336 nt, synthetic construct
  misc_feature 1..336: note = derived and/or modified sequence opt2 from anti-HIV_LightChain
  source 1..336: mol_type = other RNA
gacatcgtcatgacccagcagacccccctcaccctctccatcaccatcggccagcccgcctccatctcctgcaagtcctcccagtccctcctcgactccgacggcaagacctacctcaactggctcctccagcgccccggccagtcccccaagcgcctcatctactggatgtccaagctcgactccggcgtccccgaccgcttcaccggctccggctccggcaccgacttcaccctcaagatctcccgcgtcgaggccgaggacctcggcgtctactactgctggcagggcacccacttcccctggaccttcggcggcggcaccaagctcgagctc

SEQ ID NO: 19364 - RNA, 339 nt, synthetic construct
  misc_feature 1..339: note = derived and/or modified sequence opt2 from anti-HIV_LightChain
  source 1..339: mol_type = other RNA
gacatcgtcatcacccagtccaccaagttcatgtccacctccgtcggcgaccgcgtctccatcacctgcaaggcctcccaggacgtctccaccgccgtcgcctggtaccagcagaagcccggccagtcccccaagctcctcatctactgggcctccacccgccacaccggcgtccccgaccgcttcaccggctccggctccggcaccgactacaccctcaccatctcccgcgtccaggccgaggacctcgccctctactactgccagcagcactacaccaccccctggaccttcggcggcggcaccaagctcgagatcaagcgcaccgtcgccgccccc

SEQ ID NO: 19365 - RNA, 339 nt, synthetic construct
  misc_feature 1..339: note = derived and/or modified sequence opt2 from anti-HIV_Chain
  source 1..339: mol_type = other RNA
gacatccagatgacccagtccccctcctccctctccgcccgcgtcggcgacaccgtcaccttcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgccgtccccggcacccgcctcgacctcaagcgcaccgtcgccgccccctccgtcttcatcttcccctccgac

SEQ ID NO: 19366 - RNA, 339 nt, synthetic construct
  misc_feature 1..339: note = derived and/or modified sequence opt2 from anti-HIV_Chain
  source 1..339: mol_type = other RNA
cagtccgtcctcacccagcccgcctccgtctccggctcccccggccagtccatcaccatctcctgcaccggcaccaactccgacgtcggctactcctacgtctcctggttccagcagcaccccggcaaggtccccaagctcctcatctacgacgtctcccgccgctcctccggcgtctccaaccgcttctccggctcccgctccggcaacaccgcctccctcaccatctccggcctccgcgccgaggacgaggccgactactactgcggctccttcaccacctccctcaccctcgtcttcggcggcggcaccaagctcgccgtcctcgtctccccctcc

SEQ ID NO: 19367 - RNA, 339 nt, synthetic construct
  misc_feature 1..339: note = derived and/or modified sequence opt2 from anti-HIV_Chain
  source 1..339: mol_type = other RNA
tccctctccgcctccgtcggcgaccgcgtcaccatcacctgccgcgcctccgagtccatctccttctacctcaactggtaccagcagaagcccggcaaggcccccgagctcctcatcttcgccacctccaccctccactccggcgtcccctcccgcttctccggctccggctccggcaccgacttcaccctcaccatctcctccctccagctcgaggacttcgccacctactactgccagcagtcctcctccacccccttcaccttcggcggcggcaccaaggtcgagatcaagcgcaccgtcgccgccccctccgtcttcatcttccccccctccgac

SEQ ID NO: 19368 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcatcgtccccggcacccgcctcgacctcaagcgcaccgtcgccgccccctccgtcttcatcttccccccctccgac

SEQ ID NO: 19369 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgccgtccccggcacccgcctcgacctcaagcgcaccgtcgccgccccctccgtcttcatcttccccccctccgac

SEQ ID NO: 19370 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgtcgtccccggcacccgcctcgacctcaagcgcaccgtcgccgccccctccgtcttcatcttccccccctccgac

SEQ ID NO: 19371 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcccgcgtcggcgacaccgtcaccttcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgccgtccccggcacccgcctcgacctcaagcgcaccgtcgccgccccctccgtcttcatcttccccccctccgac

SEQ ID NO: 19372 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatgtacgacggctccaccctcgagcgcggcgtccccgcccgcttctccggccgccgctggggccaggagtacaacctcaccatcaacaacctccagcccgaggacgtcgccacctacttctgccaggtctacgagttcatcgtccccggcacccgcctcgacctcaagcgcaccgtcgccgccccctccgtcttcatcttccccccctccgac

SEQ ID NO: 19373 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccaggccgaggacatcgccacctacttctgccaggtctacgagttcgccgtccccggcacccgcctcgacctcaagcgcaccgtcgccgccccctccgtcttcatcttccccccctccgac

SEQ ID NO: 19374 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcctccgtcggcgacaccgtcaccttcacctgccaggccaacggctacctcaactggtaccagcagcgccgcggcaaggcccccaagctcctcatctacgacggctcccgcctcgagcgcggcgtcccctcccgcttctccggccgccgctggggccaggagtacaacctcaccatcaacaacctccagcccgaggacatcgccacctacttctgccaggtctacgagttcgccgtccccggcacccgcctcgacctcaagcgcaccgtcgccgccccctccgtcttcatcttccccccctccgac

SEQ ID NO: 19375 - RNA, 342 nt, synthetic construct
  misc_feature 1..342: note = derived and/or modified sequence opt2 from anti-HIV_Chain
  source 1..342: mol_type = other RNA
gacatccagatgacccactccccctcctccctctccgcctccgtcggcgacaccgtcaccatcacctgccaggccaacggctacctcaactggtaccagcagcgccgcggcaaggcccccaagctcctcatctacgacggctccaagctcgagaccggcgtcccctcccgcttcaccggccgccgctggggccaggagtacaacctcaccatcaacaacctccagcccgaggacatcgccacctacttctgccaggtctacgagttcatcgtccccggcacccgcctcgacctcaagcgcaccgtcgccgccccctccgtcttcatcttccccccctccgac

SEQ ID NO: 19376 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcccgcgtcggcgacaccgtcaccatcacctgccaggccaacggctacctcaactggtaccagcagcgccgcggcaaggcccccaagctcctcatctacgacggctccaagctcgagaccggcgtcccctcccgcttcaccggccgccgctggggccaggagtacaacctcaccatcaacaacctccagcccgaggacatcgccacctacttctgccaggtctacgagttcatcgtccccggcacccgcctcgacctcaagcgcaccgtcgccgccccctccgtcttcatcttccccccctccgac

SEQ ID NO: 19377 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcccgcgtcggcgacaccgtcaccttcacctgccaggccaacggctacctcaactggtaccagcagcgccgcggcaaggcccccaagctcctcatctacgacggctccaagctcgagcgcggcgtcccctcccgcttctccggccgcggctggggccaggagtacaacctcaccatcaacaacctccagcccgaggacatcgccacctacttctgccaggtctacgagttcgccgtccccggcacccgcctcgacctcaagcgcaccgtcgccgccccctccgtcttcatcttccccccctccgac

SEQ ID NO: 19378 - RNA, 342 nt, synthetic construct
  misc_feature 1..342: note = derived and/or modified sequence opt2 from anti-HIV_Chain
  source 1..342: mol_type = other RNA
gacatccagatgacccagtccccctcctccctctccgcctccgtcggcgacaccgtcaccatcacctgccaggccaacggctacctcaactggtaccagcagcgccgcggcaaggcccccaagctcctcatctacgacggctccaagctcgagcgcggcgtcccctcccgcttctccggccgccgctggggccaggagtacaacctcaccatcaacaacctccagcccgaggacatcgccacctacttctgccaggtctacgagttcgtcgtccccggcacccgcctcgacctcaagcgcaccgtcgccgccccctccgtcttcatcttccccccctccgac

SEQ ID NO: 19379 - RNA, 342 nt, synthetic construct
  misc_feature 1..342: note = derived and/or modified sequence opt2 from anti-HIV_Chain
  source 1..342: mol_type = other RNA
tcccagtccgtcgtcacccaggagccctccctcaccgtctcccccggcggcaccgtcaccctcacctgcggcccctccaccggcgccgtcacctccggcttctacccccactggttccagcagaagcccggccaggccccccgcgccctcatctactccacctccaacaagtactcctggacccccgcccgcttctccggctccctcctcggcggcaaggccgtcctcaccctctccgacgtccagcccgacgacgaggccgagtactactgcctcctcctcctctactacggcggcccctggatcttcggcggcggcaccaagctcaccgtcctcgtctcc

SEQ ID NO: 19380 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaaggtcaccatcacctgccagacctccgccggctacctcaactggtaccagcagcgccgcggccgcgcccccaagctcctcatgtacgacggctcccgcctcgtcaccggcgtcccctcccgcttctccggccgccgctggggcacccagtacaacctcaccatcggctccctccagcccgaggacgtcgccacctactactgccaggtctacgagttcttcggccccggcacccgcctcgacctcaagcgcaccgtcgccgccccctccgtcttcatcttccccccctccgac

SEQ ID NO: 19381 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaccgtcaccatcacctgccagaccaccaagggctacctcaactggtaccagcagcgccgcggccgcgcccccaagctcctcatgttcgacggctccaagctcgtcaccggcgtcccctcccgcttctccggccgccgctggggcacccagtacaacctcaccatcggctccctccagcccgaggacctcgccacctactactgccaggtctacgagttcttcggccccggcacccgcctcgacctcaagcgcaccgtcgccgccccctccgtcttcatcttccccccctccgac

SEQ ID NO: 19382 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaccgtcaccatcacctgccagaccaacaagggctacctcaactggtaccagcagcgccgcggccgcgcccccaagctcctcatgtgcgacggctccaagctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgac

SEQ ID NO: 19383 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcccgcgtcggcgacaaggtcaccatcacctgccagacctccgccggctacctcaactggtaccagcagcgccgcggccgcgcccccaagctcctcatgtacgacggctcccgcctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgac

SEQ ID NO: 19384 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaccgtcaccatcacctgccagaccaacaagggctacctcaactggtaccagcagaagcgcggccgcgcccccaagctcctcatgtacgacggctccaagctcgtcaccggcgtcccctcccgcctctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgac

SEQ ID NO: 19385 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaccgtcaccatcacctgccagaccaacaagggctacctcaactggtaccagcagcgccgcggccgcgcccccaagctcctcatgtacgacggctccaagctcgtcaccggcgtcccctcccgcctctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgac

SEQ ID NO: 19386 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaccgtcaccatcacctgccacaccaacaagggctacctcaactggtaccagcagcgccgcggccgcgcccccaagctcctcatgttcgacggctccaagctcgtcaccggcgtcccctcccgcttctccggccgccgctggggcacccagtacaacctcaccatcggctccctccagcccgaggacatcgccacctactactgccaggtctacgaggtcttcggccccggcacccgcctcgacctcaagcgcaccgtcgccgccccctccgtcttcatcttccccccctccgac

SEQ ID NO: 19387 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaccgtcaccatcaactgccagaccaacaagggctacctcaactggtaccagcagcgccgcggccgcgcccccaagctcctcatgtacgacggctccaagctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgac

SEQ ID NO: 19388 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcccgcgtcggcgacaaggtcaccatcacctaccagacctccgccggctacctcaactggtaccagcagcgccgcggccgcgcccccaagctcctcatgtacgacggctcccgcctcgtcaccggcgccccctcccgcttctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgac

SEQ ID NO: 19389 - RNA, 345 nt, synthetic construct
  misc_feature 1..345: note = derived and/or modified sequence opt2 from anti-HIV_Chain
  source 1..345: mol_type = other RNA
gacatccagatgacccagtccccctcctccctctccgcctccgtcggcgacaccgtcaccatcacctgccagaccaacaagggctacctcaactggtaccagcagcgccgcggccgcgcccccaagctcctcatgtacgacggctccaagctcgtcaccggcgtcccctcccgcttctccggccgccgctggggcacccagtacaacctcaccatcggctccctccagcccgaggacatcgccacctactactgccaggtctacgagttcttcggccccggcacccgcctcgacctcaagcgcaccgtcgccgccccctccgtcttcatcttccccccctccgac

SEQ ID NO: 19390 - RNA, 345 nt, synthetic construct
  misc_feature 1..345: note = derived and/or modified sequence opt2 from anti-HIV_Chain
  source 1..345: mol_type = other RNA
gtcaccctctccctctcccccggcgagcgcgccaccctctcctgccgcgcctcccagaccatctccaacaactacctcgcctggtaccagcagaagcccggccaggccccccgcctcctcatctacggcgcctcctccggcgccaccggcctccccgaccgcttctccggctccggctccggcaccgacttcaccctcaccatctcccgcctcgagcccgaggacttcgccgtctactactgccaccagtacgccctctccccctggaccttcggccgcggcaccaaggtcgagatcaagcgcaccgtcgccgccccctccgtcttcatcttccccccctccgac

SEQ ID NO: 19391 - RNA, 345 nt, synthetic construct
  misc_feature 1..345: note = derived and/or modified sequence opt2 from anti-HIV_Chain
  source 1..345: mol_type = other RNA
accctctccgcctccgtcggcgaccgcgtcaccatcacctgccgcgcctcccagtccatcaacaactacctcaactggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgtcacctactactgccagcagacctactccaacccccgcatgttcggccagggcaccaaggtcgagatcaagcgcaccgtcgccgccccctccgtcttcatcttccccccctccgacgagcag

SEQ ID NO: 19392 - RNA, 345 nt, synthetic construct
  misc_feature 1..345: note = derived and/or modified sequence opt2 from anti-HIV_Chain
  source 1..345: mol_type = other RNA
cagtccgccctcacccaggccccctccgcctccggcacccccggccagcgcgtcaccatctcctgctccggcggcggctccaacatcggcggcaacctcgtctcctggtaccagcacttccccggcgccgcccccaagctcctcatctaccgcaacgaccagcgcccctccggcgtccccgaccgcttctccgcctccaagtccggcacctccgcctccctcgccatctccggcctccgctccgacgacgaggccacctacttctgcgccgcctacgactccaccctctccctccgcctcttcggcggcggcaccaccctcgccgtcctctcccagcccaaggcc

SEQ ID NO: 19393 - RNA, 345 nt, synthetic construct
  misc_feature 1..345: note = derived and/or modified sequence opt2 from anti-HIV_Chain
  source 1..345: mol_type = other RNA
aagccctcccagaccctctccctcacctgcaccgtctccggcggctccatctcctccgccggctactactggacctggatccgccaccaccccggcaagggcctcgagttcatcggctacatctaccacatcggcaccccctactacaacccctccctcaagtcccgcctcaccatctccatcgacacctccaagaaccagttctccctcaagctctcctccgtcaccgccgccgacaccgccatctactactgcgcccgcgactacaccgcccgcggccgccacttcttcgactactggggccagggcgccctcgtcaccgtctcctccgcctccaccaagggc

SEQ ID NO: 19394 - RNA, 345 nt, synthetic construct
  misc_feature 1..345: note = derived and/or modified sequence opt2 from anti-HIV_Chain
  source 1..345: mol_type = other RNA
ccctccgagaccctctccctcacctgccgcgtctccggcgcctccatctccaacttctactggacctggatccgccagcccgccggcaagggcctcgagtggatcggccgcctctactcctccgacaagaccaactacaacccctccctcaacggccgcgtcaccatgtccctcgacacctccaagaaccagttctccctccgcctcacctccatgaccgacgccgacaccgccatctactactgcgcccgcgagaagggccagtgggtcaccctccccccctactacttcgactcctggggccagggcatcctcgtcaccgtctcctccgcctccaccaagggc

SEQ ID NO: 19395 - RNA, 348 nt, synthetic construct
  misc_feature 1..348: note = derived and/or modified sequence opt2 from anti-HIV_Chain
  source 1..348: mol_type = other RNA
ggccccgccaccctctccgtctcccccggcgagcgcgccaccctctcctgccgcgcctcccagtccctccgcaacaacctcgcctggtaccagcagaagaccggccagtccccccgcctcctcatctacgccgtctccacccgcgccaccggcatccccccccgcttctccggcggcggctccggcaccgagttcaccctcaccatcgactccctccagtccgaggacttcgccgtctacttctgccagcagtacgactccccccagtggaccttcggccagggcaccaaggtcgagatcaagcgcaccgtcgccgccccctccgtcttcatcttccccccctccgac

SEQ ID NO: 19396 - RNA, 348 nt, synthetic construct
  misc_feature 1..348: note = derived and/or modified sequence opt2 from anti-HIV_Chain
  source 1..348: mol_type = other RNA
gcccccgtcaccctctccgcctccgtcggcgacaccgtcaccatcacctgccgcgcctcccagcccatcgccaccttcctcaactggtaccagcacaagcccggccaggcccccaagctcctcatctacgccgcctccaccttccagcgcggcgccccctcccgctactccggctccggctccggcaccgacttcaccctcaccatcaactccctccagcccgaggacctcgccacctactactgccagcagaccttcaccgaccccgtcaccttcggccagggcacccgcctcgagatcaagcgcaccgtcgccgccccctccgtcttcatcttccccccctccgac

SEQ ID NO: 19397 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcggctggctcgcctggtaccaccagcgccccggcaaggccccccgcctcctcatctaccgcggctcccgcctcctcggcggcgtcccctcccgcttctccggctccgccgccggcaccgacttcaccctcaccatcgccaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19398 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcaactgggtcgcctggtaccagcagcgccccggcaaggccccccgcctcctcatctaccgcggcgccgccctcctcggcggcgtcccctcccgcttctccggctccgccgccggcaccgacttcaccctcaccatcggcaacctccagaccgaggacttcggcaccttctactgccagcagtacgacacctaccccggcaccttcggccagggcaccaaggtcgaggtcaagcgcaccgtcgccgccccctccgtcttc

SEQ ID NO: 19399 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcaactgggtcgcctggtaccagcagcgccccggcaaggccccccgcctcctcatctaccgcggcgccgccctcctcggcggcgtcccctcccgcttccgcggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19400 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccgtcggcgacaccgtccgcatctcctgccgcgcctcccagtccatcaccggcggctggctcgcctggtaccaccagcgccccggcaaggccccccgcctcctcatctaccgcggctcccgcctcctcggcggcgtcccctcccgcttctccggctccgccgccggcaccgacttcaccctcaccatcgccaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19401 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcaactgggtcgcctggtaccagcagcgccccggcaaggccccccgcctcctcatctaccgcggcgccgccctcctcggcggcgtcccctcccgcttctccggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19402 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcggctgggtcgcctggtaccaccagcgccccggcaaggccccccgcctcctcatctaccgcggctcccgcctcctcggcggcgtcccctcccgcttctccggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19403 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccgtcggcgacaccgtccgcatctcctgccgcgcctcccagtccatcaccggcggctggctcgcctggtaccaccagcgccccggcaaggccccccgcctcctcatctaccgcggctcccgcctcctcggcggcgtcccctcccgcttctccggctccgccgccggcaccggcttcaccctcaccatcgccaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19404 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccgtcggcggcaccgtccgcatctcctgccgcgcctcccagtccatcaccggcggctggctcgcctggtaccaccagcgccccggcaaggccccccgcctcctcatctaccgcggctcccgcctcctcggcggcgtcccctcccgcttctccggctccgccgccggcaccgacttcaccctcaccatcgccaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19405 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcaactgggtcgcctggtaccaccagcgccccggcaaggccccccgcctcctcatctaccgcggcgccgccctcctcggcggcgtcccctcccgcttctccggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19406 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtcatgatctcctgccgcgcctcccagtccatcaccggcggctggctcgcctggtaccaccagcgccccggcaaggccccccgcctcctcatctaccgcggctccaagctcctcggcggcgtcccctcccgcttctccggctccgccgccggcaccggcttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19407 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccgtcggcgacaccgtccgcatctcctgccgcgcctcccagtccatcaccggcggctggctcgcctggtaccaccagcgccccggcaaggccccccgcctcctcatctaccgcggctcccgcctcctcggcggcgtcccctcccgcttctccggctccgccgccggcgccgacttcaccctcaccatcgccaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19408 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcggctggctcgcctggtaccaccagcgccccggcaaggccccccgcctcctcatctaccgcggctcccgcctcgtcggcggcgtcccctcccgcttctccggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19409 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcggctggctcgcctggtaccaccagcgccccggcaaggccccccgcctcctcatctaccgcggctcccgcctcctcggcggcgtcccctccaagttctccggctccgccgccggcaccgacttcaccctcaccatcgccaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19410 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccaccggcgacaccgtccgcatctcctgccgcgcctcccagtccatcaccggcaactgggtcgcctggtaccagcagcgccccggcaaggccccccgcctcctcatctaccgcggcgccgccctcctcggcggcgtcccctcccgcttccgcggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19411 - RNA, 351 nt, synthetic construct
  misc_feature 1..351: note = derived and/or modified sequence opt2 from anti-HIV_LightChain
  source 1..351: mol_type = other RNA
gacatccagatgacccagtccccctccaccctctccgcctccatcggcgacaccgtccgcatctcctgccgcgcctcccagtccatcaccggcaactggctcgcctggtaccaccagcgccccggcaaggccccccgcctcctcatctaccgcggctcccgcctcctcggcggcgtcccctcccgcttctccggctccgccgccggcaccgacttcaccctcaccatcgccaacctccaggccgaggacttcggcaccttctactgccagcagtacgacacctaccccggcaccttcggccagggcaccaaggtcgaggtcaagcgcaccgtcgccgccccctccgtcttc

SEQ ID NO: 19412 - RNA, 351 nt, synthetic construct
  misc_feature 1..351: note = derived and/or modified sequence opt2 from anti-HIV_Chain
  source 1..351: mol_type = other RNA
atcatcctcttcctcgtcgccaccgccaccggctcctgggcccagtccgccctcacccagccccgctccgtctccggctccctcggccagtccgtcaccatctcctgcaccggctcctcctccgacgtcggccgctacaactacgtctcctggtaccagcaccaccccggcaaggcccccaagctcatgatctccgacgtcaacaagcgcccctccggcgtccccgaccgcttctccggctccaagtccggcaacaccgcctccctcaccatctccggcctccaggccgaggacgagaccgactactactgctgctcctacgccggctcctacatctgggtcttcggcggc

SEQ ID NO: 19413 - RNA, 351 nt, synthetic construct
  misc_feature 1..351: note = derived and/or modified sequence opt2 from anti-HIV_Chain
  source 1..351: mol_type = other RNA
cccgtcaccctctccgcctccgtcggcgaccgcgtcaccatcacctgccgcgcctccgaggacatctccaagtacctcaactggtaccagcacaagcccggcaaggcccccaagctcctcatctacaccgcctcctccctcgagaccggcgtcccctcccgcttctccggctccggctccggcaccgacttctccctcaccatctcctccctccagcccgacgacttcgccacctactactgccagcagtcctacacctcctccgtcaccttcggccagggcacccgcgtcgaggtcaagcgcaccgtcgccgccccctccgtcttcatcttccccccctccgacgagcag

SEQ ID NO: 19414 - RNA, 351 nt, synthetic construct
  misc_feature 1..351: note = derived and/or modified sequence opt2 from anti-HIV_Chain
  source 1..351: mol_type = other RNA
gtcgaggagcccggctcctccgtcaaggtctcctgcaaggcctccggcggctcctccaccgcctacggctactcctgggtccgccaggcccccggccagggcttcgagtggatgggccgcatcatccccttctacggcatcatcacctacgcccccaagttccagggccgcgtcaccatcaccgccgaccgctccacctccaccgtctacatggagctcacccgcctcaccttcgccgacaccgccctcttcttctgcgcccgcgactacggcgacccccgcaacggctactacttcgactcctgggaccagggcctctggctcaccgtctcctccgcctccaccaagggc

SEQ ID NO: 19415 - RNA, 351 nt, synthetic construct
  misc_feature 1..351: note = derived and/or modified sequence opt2 from anti-HIV_Chain
  source 1..351: mol_type = other RNA
caggtccgcctcgagcagtccggcgccgccgtccgcacccccggcgcctccgtcaccctctcctgccaggcctccggctacaagttcgtcaactacatcatccactgggtccgccagcgccccggcctcgccttcgagtgggtcggcatgatcgacccctaccgcggccgcccctggtccgcccactccttcgagggccgcctctccctctcccgcgacgtctccatggagatcctctacatgaccctcacctccctccgctccgacgacaccgccacctacttctgcgcccgcgccgaggccgagtcccagtcccactcccgccccatcatctccacctccggcgcccgc

SEQ ID NO: 19416 - RNA, 351 nt, synthetic construct
  misc_feature 1..351: note = derived and/or modified sequence opt2 from anti-HIV_Chain
  source 1..351: mol_type = other RNA
gtccacctcgaggtccagctccagcagtccggccccgagctcaagaagcccggcgagaccgtcaagatctcctgcaaggcctccgtctacaccttcaccgagtaccccatccactgggtcaagcaggcccccggcaagggcttcaagtggatgggctggatcaacacctactccggcgagcccacctacgccgacgacttcaagggccgcttcgccttctccctcgagacctccgcctccaccgcctacctccagatcaactccctcaagaacgaggacaccgccacctacttctgcgcctccctcggccgcgactactggggccagggccagggcaccaccctcaccgtc

SEQ ID NO: 19417 - RNA, 354 nt, synthetic construct
  misc_feature 1..354: note = derived and/or modified sequence opt2 from anti-HIV_Chain
  source 1..354: mol_type = other RNA
ctctccgtctccctcggcgagcgcgccaccatcaactgcaagtcctcccagtccatcctctactcctccgacaagaagaactacctcgcctggtaccagcagaagatcggccagccccccaagctcctcctctactgggcctccacccgcgagtccggcatccccgaccgcttctccggctccggctccggctccgacttcaccctcaccatctcctccctccagcccgaggacgtcgccgtctactactgccagcagtactacatctcccccttcaccttcggccccggcaccaaggtcgacctcaagcgcaccgtcgccgccccctccgtcttcatcttccccccctccgac

SEQ ID NO: 19418 - RNA, 354 nt, synthetic construct
  misc_feature 1..354: note = derived and/or modified sequence opt2 from anti-HIV_Chain
  source 1..354: mol_type = other RNA
cagtccgtcctcacccagcccccctccgcctccggcgcccccggccagcgcgtcaccatctcctgctccggcggcccctccaacgtcggcggcaactacgtctactggtaccgccagttccccggcaccgcccccaagctcctcatcctccgcgacgaccagcgcccctccggcgtccccgaccgcttctccgcctccaagtccggcaactccgcctccctcgccatctccggcctccgccccgacgacgaggccttctacttctgcgccacctacgactccgacggctccatccgcctcttcggcggcggcaccgccctcaccgtcctctcccagcccaaggccgccccctcc

SEQ ID NO: 19419 - RNA, 354 nt, synthetic construct
  misc_feature 1..354: note = derived and/or modified sequence opt2 from anti-HIV_Chain
  source 1..354: mol_type = other RNA
aaggcccccgccaccctctccctctcccccggcgagcgcgccaccctctcctgccgcgcctcccagtccgtcggctccgacctcgcctggtaccagcagaagcccggccaggccccccgcctcctcatctacgacgcctccaaccgcgccaccgccatccccgcccgcttctccggctccggctccggcaccgacttcaccctctccatctcctccctcgagcccgaggacttcgccgtctacttctgccagcagcgctacgacaagatcaccttcggccagggcacccgcctcgagatccagcgcaccgtcgccgccccctccgtcttcatcttccccccctccgacgagcag

SEQ ID NO: 19420 - RNA, 354 nt, synthetic construct
  misc_feature 1..354: note = derived and/or modified sequence opt2 from anti-HIV_Chain
  source 1..354: mol_type = other RNA
caggtccagctcgtccagtccggcgccgaggccaagcgccccggcgactccgtcaaggtctcctgcaaggcctccggctacaccttcaccgagtactacatccactgggtccgccagacccccggccagggcttcgagtggatgggcatcatcacccccggcgccggcaacaccacctacgcccagaagttccagggccgcatcaccgtcacccgcgacacctccgccgccaccgtctacatggagctctccaacctcacctccgaggacaccgccgtctacttctgctcccgcggcgtctccttctggggccagggcaccctcgtcaccgtctcctccgcctccaccaagggc

SEQ ID NO: 19421 - RNA, 354 nt, synthetic construct
  misc_feature 1..354: note = derived and/or modified sequence opt2 from anti-HIV_HeavyChain
  source 1..354: mol_type = other RNA
gaggtcaagctccagcagtccggcgccgagctcgtccgccccggcgcctccgtcaagatgtcctgcaaggcctccggctaccgcttcacctcctacaacatgcactgggtcaagcagaccccccgccagggcctcgagtggatcggcgccatctaccccggcaacggcgacacctcctacaaccagaagttcaagggcaaggccaccctcaccgtcgacaagtcctcctccaccgcctacatgcagctctcctccctcacctccgaggactccgccgtctacttctgcgcccgcggccgcctctccctcggcttcgactactggggccagggctccaccctcaccgtctcctcc

SEQ ID NO: 19422 - RNA, 357 nt, synthetic construct
  misc_feature 1..357: note = derived and/or modified sequence opt2 from anti-HIV_Chain
  source 1..357: mol_type = other RNA
caggtccagctcgtccagtccggcaccgccgtcaagcgccccggcgcctccgtccgcgtctcctgccaggcctccggctacaccttcatcgaccacttcatctactggtggcgccaggcccccggccagggcctcgagtggctcggctggatcaaccccctcacctcccagccctcctacccctcccgcttccagggccgcctcaccctcacccgcgacaccttcgacgagatgctctacatggacctccgcggcctccgctccgacgacaccggcatctacttctgcgcccgccgccactccgactactgcgacttcgacatctggggctccggcacccagatcatcgtctcctcc

SEQ ID NO: 19423 - RNA, 357 nt, synthetic construct
  misc_feature 1..357: note = derived and/or modified sequence opt2 from anti-HIV_Chain
  source 1..357: mol_type = other RNA
caggtccagctcgtccagtccggcaccgccgtcaagcgccccggcgcctccgtccgcgtctcctgccaggcctccggctacaccttcaccgactacttcatctactggtggcgccaggcccccggccagggcctcgagtggctcggctggatcaaccccctcacctcccagccctcctacccctcccgcttccagggccgcctcaccctcacccgcgacaccttcgacgagatgctctacatggacctccgcggcctccgctccgacgacaccggcatctacttctgcgcccgccgccactccgactactgcgacttcgacatctggggctccggcacccagatcatcgtctcctcc

SEQ ID NO: 19424 - RNA, 357 nt, synthetic construct
  misc_feature 1..357: note = derived and/or modified sequence opt2 from anti-HIV_Chain
  source 1..357: mol_type = other RNA
cagtccgtcctcacccagccccgctccgtctccggctcccccggccagtccgtcaccatctcctgcaccggcacctcctccgacgtcggcggctacaactacgtctcctggtaccagcagcaccccggcaaggcccccaagaccatgatcttcgacgtcaccaagcgcccctccggcgtccccgaccgcttctccggctccaagtccggcaacaccgcctccctcaccatctccggcctccaggccgaggacgaggccgactactactgctcctcctacgccggccgcaacaccttctacgtcttcggcaccggcaccaccgtcaccgtccaggtctccccctcccagccccccccc

SEQ ID NO: 19425 - RNA, 357 nt, synthetic construct
  misc_feature 1..357: note = derived and/or modified sequence opt2 from anti-HIV_Chain
  source 1..357: mol_type = other RNA
gagatcgtcctcacccagtcccccggcaccctctccctctcccccggcgagcgcgccaccctctcctgccgcgcctcccagtccgtctcctccaactacctcgcctggtaccagcagaagcccggccaggccccccgcctcctcatctacggcgcctcctcccgcgccaccggcatccccgaccgcttctccggctccggctccggcaccgacttcaccctctccatctcccgcctcgagcccgaggacttcgccgtctactactgccagcagtacggcacctcctcctgcaccttcggccagggcaccaagctcgagatcaagcgcaccgtcgccgccccctccgtcttcatcttc

SEQ ID NO: 19426 - RNA, 357 nt, synthetic construct
  misc_feature 1..357: note = derived and/or modified sequence opt2 from anti-HIV_Chain
  source 1..357: mol_type = other RNA
ctctccgcctccgtcggcgaccgcgtcaccatcacctgccgcgcctcccagtccatcgaccgctacctcaactggtaccagcagaagcccggcaaggcccccaagctcctcatctacgccgcctcctccctccacaccgacgtcccctcccgcttctccggctccggcgccggcacctacttcaccctcaccatcacctccctccagcccgaggacttcgccacctactactgccagcagtcccactccccctccttcggccaggagtcctactccatcaccttcggccagggcacccgcctcgagatcaagcgcaccgtcgccgccccctccgtcttcatcttccccccctccgac

SEQ ID NO: 19427 - RNA, 357 nt, synthetic construct
  misc_feature 1..357: note = derived and/or modified sequence opt2 from anti-HIV_Chain
  source 1..357: mol_type = other RNA
aacttcatgctcacccaggccccctccgcctccggcgcccccggccagcgcgtcaccatctcctgctccggcggcccctccaacgtcggcggcaactacgtctactggtaccgccagtaccccggcaccgcccccaagctcctcatcctccgcgacgaccagcgcccctccggcgtccccgaccgcttctccgcctccaagtccggcaactccgcctccctcgccatctccgagctccgccccgacgacgaggccttctacttctgcgccacctacgactccgacggctccatccgcctcttcggcggcggcaccgccctcaccgtcctctcccagcccaaggccgccccctccgtc

SEQ ID NO: 19428 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctctccgcctccatcggcgaccgcgtcaacatcacctgccaggcctcccgcgacaccggctccgccctcaactggtaccagcagaaggtcggccgccccccccgcctcctcatctccgccgtctccaacctcggcgccggcgtcccctcccgcttctccggccgccgctccggcacccagtccaccctcaccatcaacaccctccagcccgaggacatcgccacctacttctgccagcactacgagttcttcggccccggcaccaaggtcgacatcaagcgcaccgtcgccgccccctccgtcttcatcttccccccctccgacgagcag

SEQ ID NO: 19429 - RNA, 360 nt, synthetic construct
  misc_feature 1..360: note = derived and/or modified sequence opt2 from anti-HIV_Chain
  source 1..360: mol_type = other RNA
cagtccgtcctcacccagcccgcctccgtctccggctcccccggccagtccatcaccatctcctgcaccggcacctccaacgacgtcggcggccagaacttcgtctcctggtaccagcagcaccccggcaccgccccccagctcctcatctacgacgtcaccaaccgccccgccggcgtctcctcccgcttctccggctccaagtccggcaacaccgcctccctcaccatctccggcctccgcaccgaggacgaggccgactactactgcgcctccttcaccatcctcaacggcgtcgactacgtcttcggcaccggcaccaaggtcaccgtcctcctctccccctcccagccctacctc

SEQ ID NO: 19430 - RNA, 360 nt, synthetic construct
  misc_feature 1..360: note = derived and/or modified sequence opt2 from anti-HIV_Chain
  source 1..360: mol_type = other RNA
aacttcatgctcacccagcccgcctccgtctccggctcccccggccagtccatcaccctctcctgcaccggcaccacctccgacgtccgcgactccaacttcgtctcctggtaccagcaggtccccggcaaggcccccaagctcatcatctacgacgtctccgcccgcccctccggcgtctccttccgcttctccggctccaagtccggcaacaccgcctccctcaccatctccggcctccaggccgaggacgaggccctctactactgctcctccttcacccccaccaacaccctcgtcttcggcggcggcaccaagctcaccgtcctcggccagcccaaggccgccccctccgtcacc

SEQ ID NO: 19431 - RNA, 360 nt, synthetic construct
  misc_feature 1..360: note = derived and/or modified sequence opt2 from anti-HIV_Chain
  source 1..360: mol_type = other RNA
cagtccgccctcacccagccccccgccgcctccggcgcccccggccagcgcgtcaccatctcctgctccggcggcggctccaacgtcggcggcaacctcgtctcctggtaccagcagttccccggcgccgcccccaagctcatcctccaccgcgacggccagcgcccctccggcgtccccgaccgcttctccgcctccaagtccggcacctccgcctccctcaccatctccggcctccgctccgacgacgaggccacctacttctgcgccgcctacgactccgccgtctccctccccgtcttcggcggcggcaccaagctcaccgtcctctcccagcccaaggccgcccccctcgtcacc

SEQ ID NO: 19432 - RNA, 360 nt, synthetic construct
  misc_feature 1..360: note = derived and/or modified sequence opt2 from anti-HIV_Chain
  source 1..360: mol_type = other RNA
cagctcgtcctcacccagcccccctccgtctccggcacccccggccagaacgtcaccatctcctgctccggcggcggctcccacgtcggcggcaacctcgtctcctggtaccagcacttccccggcgccgcccccaagctcctcatccaccgcgacaaccagcgcccctccggcgtccccgaccgcttctccgccctcaagtccggcaactccgcctccctcgccatctccggcctccgctccgacgacgaggccttctacttctgcgccgtctacgactcctccctctccctcggcctcttcggcggcggcaccaagctcaccgtcctctcccagcccaaggccgccccctccgtcacc

SEQ ID NO: 19433 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctctccgcctccgtcggcgaccgcgtctccatccactgccaggccggccagggcatcggctcctccctcaagtggtaccagcagaagtccggccgcgccccccgcctcctcgtccacggcgcctccaacctccagcgcggcgtcccctcccgcttctccggctccggcttccacaccaccttcaccctcaccatctcctccctccagcccgacgacgtcgccacctactggtgcgccgtcctcgagttcttcggccccggcaccaaggtcgagatcaagcgcaccgtcgccgccccctccgtcttcatcttccccccctccgacgagcag

SEQ ID NO: 19434 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctctccgcctccgtcggcgaccgcgtcaccatcacctgccaggcctcccagggcatcggctcctccctccagtggtaccagcagaagcccggccgcgcccccaagctcctcgtccacggcgcctccaacctccaccgcggcgtcccctcccgcttctccggctccggcttccacacctccttcaccctcaccatctcctccctccagcccgacgacgtcgccacctacttctgcgccgtcctcgagttcttcggccccggcaccaaggtcgagatcaagcgcaccgtcgccgccccctccgtcttcatcttccccccctccgacgagcag

SEQ ID NO: 19435 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctctccgcctccgtcggcgaccgcgtctccatcaactgccaggccggccagggcatcggctcctccctcaactggtaccagcagaagcgcggcaaggcccccaagctcctcgtccacggcgcctccaccctccagcgcggcgtcccctcccgcttctccggctccggcttccacaccaccttcaccctcaccatctcctccctccagcccgacgacgtcgccacctacttctgcgagtccttccagtggttcggccccggcaccaaggtcgagatcaagcgcaccgtcgccgccccctccgtcttcatcttccccccctccgacgagcag

SEQ ID NO: 19436 - RNA, 360 nt, synthetic construct
  misc_feature 1..360: note = derived and/or modified sequence opt2 from anti-HIV_Chain
  source 1..360: mol_type = other RNA
tacatccagatgacccagtccccctcctccctctccgcctccatcggcgaccgcgtcaccatcacctgccaggccggccagggcatcggctcctccctcaactggtaccagcagaagcccggcaaggcccccaagctcctcgtccacggcgcctccaacctccagcgcggcgtctcctcccgcttctccggctccggcttccacaccaccttcaccctcaccatctcctccctccgccccgaggacgtcggcacctacttctgcgaggtctacgagttcatcggccccggcaccaaggtcgacatcaagcgcaccgtcgccgccccctccgtcttcatcttccccccctccgacgagcag

SEQ ID NO: 19437 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctccccgcctccgtcggcgacaccgtcaccatcacctgccaggccggccagggcatcggctcctccctccagtggtaccagcagcgccccggccgcgcccccaacctcctcgtctacgacgcctccaacctccagcgcggcgtcccctcccgcttcaccggcaccggcttccacaccaccttcaccctcaccatccgcggcctccgccccgaggacttcggcacctacttctgcgcctccctcgagttcttcggccccggcaccaaggtcgacatcaagcgcaccgtcgccgccccctccgtcttcatcttccccccctccgacgagcag

SEQ ID NO: 19438 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctctccgcctccgtcggcgaccgcgtcaccatcacctgccaggcctcccagggcatcggctcctccctccagtggtaccagcagaagcccggccgcgcccccaacctcctcgtccacggcgcctccaacctccaccgcggcgtcccctcccgcttctccggctccggcttccacaccaccttctccctcaccatctccggcctccagcgcgacgacttcgccacctacttctgcgccgtcctcgagttcttcggccccggcaccaaggtcgacatcaagcgcaccgtcgccgccccctccgtcttcatcttccccccctccgacgagcag

SEQ ID NO: 19439 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctctccgtctccgtcggcgaccgcgtctccatcacctgccgcgccacccagggcatcggcaactccctcaactggtaccagcagaagcccggcaaggcccccaaggtcctcatctacggcaccaccaagctccacggcggcgtcccctcccgcttctccggcggcggctccggctccaccggcaccctcaccatcgactccctccagcccgaggacatcgccacctacttctgccagctcttcgagttcttcggccccggcaccaaggtcgagatcaagcgcaccgtcgccgccccctccgtcttcatcttccccccctccgacgagcag

SEQ ID NO: 19440 - RNA, 360 nt, synthetic construct
  misc_feature 1..360: note = derived and/or modified sequence opt2 from anti-HIV_Chain
  source 1..360: mol_type = other RNA
gacatccagatgacccagtccccctcctccctctccgcctccgtcggcgaccgcgtcaccatcacctgccaggccggccagggcatcggctcctccctcaactggtaccagcagaagcccggccgcgcccccaagctcctcgtctacggcgcctccaacctccagcgcggcgtcccctcccgcttctccggctccggcttccacaccaccttcaccctcaccatctcctccctccagcccgaggacttcgccacctacttctgctccgtctacgagttcctcggccccggcaccaaggtcgagatcaagcgcaccgtcgccgccccctccgtcttcatcttccccccctccgacgagcag

SEQ ID NO: 19441 - RNA, 360 nt, synthetic construct
  misc_feature 1..360: note = derived and/or modified sequence opt2 from anti-HIV_Chain
  source 1..360: mol_type = other RNA
cccatgttccagcccggccagtccggcggcgtcgtcgtccagtccggcgagtccctccacctctcctgcgaggcctccggcttcaagttcgcctcccagatgatgcactgggtccgccacgtccccggccgcggcctcgagtgggtcgccctcatctcctgggacggctccggcaagctcttcgccgactccgtccgcggccgcttcaccatccaccgctggaacgaccgcaactccctctacctcgacgtcaagaacgtccgccccgaggacgccgccatctactactgcacccgcaacggcttcgacgtctggggccagggcatcctcgtcaccgtctcctccgcctccaccaagggc

SEQ ID NO: 19442 - RNA, 363 nt, synthetic construct
  misc_feature 1..363: note = derived and/or modified sequence opt2 from anti-HIV_HeavyChain
  source 1..363: mol_type = other RNA
gaggtcaagctcgtcgagtccggcggcggcctcgtccagcccggcggctccctccgcctctcctgcgccgcctccggcttcaccttctcctccttcggcatgcactgggtccgccaggcccccgagaagggcctcgagtgggtcgcctacatctcctccggctcctccaccctccactacgccgacaccgtcaagggccgcttcaccatctcccgcgacaactccaagaactccctctacctccagatgaacctcctccgcgccgaggacaccgccgtctactactgcgcccgcggctcccgcaacctctcccaccgcctcctctcctactggggccagggcaccctcgtcaccgtctcctcc

SEQ ID NO: 19443 - RNA, 363 nt, synthetic construct
  misc_feature 1..363: note = derived and/or modified sequence opt2 from anti-HIV_HeavyChain
  source 1..363: mol_type = other RNA
gaggtccagctcgtcgagtccggcggcggcctcgtccagcccggcggctccctccgcctctcctgcgccgcctccggcttcaccttctcctccttcggcatgcactgggtccgccaggcccccggcaagggcctcgagtgggtctcctacatctcctccggctcctccaccctccactacgccgacaccgtcaagggccgcttcaccatctcccgcgacaactccaagaactccctctacctccagatgaactccctccgcgccgaggacaccgccgtctactactgcgcccgcggctcccgcaacctctcccaccgcctcctctcctactggggccagggcaccctcgtcaccgtctcctcc

SEQ ID NO: 19444 - RNA, 363 nt, synthetic construct
  misc_feature 1..363: note = derived and/or modified sequence opt2 from anti-HIV_Chain
  source 1..363: mol_type = other RNA
gacatccagatgacccagtccccctcctccctctccgcctccgtcggcgaccgcgtcaccatcacctgccaggcctcccagggcatctccaactccctcaactggtaccagcagaagcccggcaaggccccccgcctcctcatctacggcacctccaccctccagcgcggcgtcccctcccgcttctccggctccggctccggcacccgcttcaccgtcaccatcaactccctccagcccgaggacatcgccacctacttctgccagcacaacgagttcttcggccgcggcaccaaggtcgacatcaagcgcaccgtcgccgccccctccgtcttcatcttccccccctccgacgagcagctc

SEQ ID NO: 19445 - RNA, 363 nt, synthetic construct
  misc_feature 1..363: note = derived and/or modified sequence opt2 from anti-HIV_Chain
  source 1..363: mol_type = other RNA
gacatccagatgacccagtccccctcctccgtctccgcctccgtcggcgaccgcgtcaccatcacctgccaggcctcccgcgacaccgacaactccctcacctggtaccagcagaagcccggccgcccccccaagctcctcatctaccacgtcgtcaacctcggccccggcgtcccctcccgcttctccggctccgcctcctccgccacccagtccaccctcatcatctccgacttccagcccgacgacgtcgccacctacttctgccagaactacgagttcttcggccccggcaccaaggtcgagatcaagcgcaccgtcgccgccccctccgtcttcatcttccccccctccgacgagcag

SEQ ID NO: 19446 - RNA, 363 nt, synthetic construct
  misc_feature 1..363: note = derived and/or modified sequence opt2 from anti-HIV_Chain
  source 1..363: mol_type = other RNA
gagatcgtcctcacccagtcccccggcaccctctccctctcccccggcgagcgcgccaccctctcctgccgcgcctcccagtccgtctcctccaacaacctcgcctggtaccagcagaagcccggccaggccccccgcctcctcatgtccggcgcctcctcccgcgccaccggcatccccgaccgcttctccggctccggctccggcaccgacttcaccctcaccatctcccgcctcgagcccgaggacttcgccgtctaccactgccagcagtacggctcctccccccccaccttcggccagggcaccaaggtcgagatcaagcgcaccgtcgccgccccctccgtcttcatcttccccccc

SEQ ID NO: 19447 - RNA, 363 nt, synthetic construct
  misc_feature 1..363: note = derived and/or modified sequence opt2 from anti-HIV_Chain
  source 1..363: mol_type = other RNA
gacatccagatgacccagtccccctcctccctctccgcctacgtcggcgaccgcgtcaccatcacctgccgcgcctcccagaacatcaacacctacctcaactggtaccagcagcgccccggcaaggcccccaagctcctcatctacgccgcctccaccctccagtccggcgtcccctcccgcttctccggctccggctccggcaccgacttcaccctcaccatctccaacctcgagaccgaggacttcgccgtctactactgccagcagacctaccgctccgtcaccttcggccagggcaccaagctcgagatcaagcgcaccgtcgccgccccctccgtcttcatcttccccccctccgac

SEQ ID NO: 19448 - RNA, 363 nt, synthetic construct
  misc_feature 1..363: note = derived and/or modified sequence opt2 from anti-HIV_Chain
  source 1..363: mol_type = other RNA
gacatccagatgacccagtccccctcctccctctccgcctccgtcggcgaccgcgtcaccatcacctgccaggccggccagggcatcggctcctccctccagtggtaccagcagaagcccggcaaggcccccaagctcctcgtccacggcgcctccaacctccaccgcggcgtcccctcccgcttctccggctccggcttccacaccaccttctccctcaccatctccggcctccagcgcgacgacttcgccacctacttctgcgccgtcgtcgagttcttcggccccggcaccaaggtcgacatcaagcgcaccgtcgccgccccctccgtcttcatcttccccccctccgacgagcagctc

SEQ ID NO: 19449 - RNA, 363 nt, synthetic construct
  misc_feature 1..363: note = derived and/or modified sequence opt2 from anti-HIV_Chain
  source 1..363: mol_type = other RNA
caggtccagctcgtcgagtccggcgccgagctccgcaagcccggcgagtccctcgagatctcctgcaaggcctccggctactccttctcctcccactggatcggctgggcccgccagatgcccggcaagggcctcgagtggatgggcatcatctaccccggcgactccaacaccatctactccccctccttccagggccaggtcaccatctccgccgacaagtccatcaacaccgcctacctccagtggtcctccctcaaggcctccgacaccgccatgtacttctgcgcctccaactaccacgactacttctactggggccagggcaccctcgtcaccgtctcctccgcctccaccaagggc

SEQ ID NO: 19450 - RNA, 363 nt, synthetic construct
  misc_feature 1..363: note = derived and/or modified sequence opt2 from anti-HIV_Chain
  source 1..363: mol_type = other RNA
ttcgtccagctcgtcgagtccggcggcggcgtcgtccagcccggcacctccctccgcctctcctgcaccacctccggcttcatcttctccgactacggcatgcactgggtccgccaggccgccggcaagggcctcgagtgggtcgccgtcatctggcacgacggctccaaccgcttctacgccgactccgtcaagggccgcttcaccatctcccgcgacaactccaagaacgccgtctacctcgagatgaacaacctccgcgtcgaggacaccgccctctactactgcgcccgcacctccatggacatcgactactggggccagggcacccccgtcaccgtctcctccgcctccaccaagggc

SEQ ID NO: 19451 - RNA, 363 nt, synthetic construct
  misc_feature 1..363: note = derived and/or modified sequence opt2 from anti-HIV_Chain
  source 1..363: mol_type = other RNA
gagcccatgttccagcccggccagtccggcggcgtcgtcgtccagtccggcgagtccctccacctctcctgcgaggcctccggcttcaagttcgcctcccagatgatgcactgggtccgccacgtccccggccgcggcctcgagtgggtcgccctcatctcctgggacggctccggcaagctcttcgccgactccgtccgcggccgcttcaccatccaccgctggaacgaccgcaactccctctacctcgacgtcaagaacgtccgccccgaggacgccgccatctactactgcacccgcaacggcttcgacgtctggggccagggcatcctcgtcaccgtctcctccgcctccaccaagggc

SEQ ID NO: 19452 - RNA, 366 nt, synthetic construct
  misc_feature 1..366: note = derived and/or modified sequence opt2 from anti-HIV_Chain
  source 1..366: mol_type = other RNA
tcccagcacctcgtccagtccggcacccaggtcaagaagcccggcgcctccgtccgcatctcctgccaggcctccggctactccttcaccgactacgtcctccactggtggcgccaggcccccggccagggcctcgagtggatgggctggatcaagcccgtctacggcgcccgcaactacgcccgccgcttccagggccgcatcaacttcgaccgcgacatctaccgcgagatcgccttcatggacctctccggcctccgctccgacgacaccgccctctacttctgcgcccgcgacggctccggcgacgacacctcctggcacctcgacccctggggccagggcaccctcgtcatcgtctccgcc

SEQ ID NO: 19453 - RNA, 366 nt, synthetic construct
  misc_feature 1..366: note = derived and/or modified sequence opt2 from anti-HIV_Chain
  source 1..366: mol_type = other RNA
gacatccagatgacccagtccccctcctccctctccgcctccgtcggcgaccgcgtcaccatcacctgccgcgcctcccagtccatctcccgctacctcaactggtaccagcagaagcccggcaaggcccccaagctcctcatctacgccgcctcctccctccagggcggcgtcccctcccgcttctccggctccggctccggcaccgacttcaccctcaccatctcctccctccagcccgaggacttcgccacctactactgccagcagtcctcctccaagcccttcaccttcggcggcggcaccaaggtcgagatcaagcgcaccgtcgccgccccctccgtcttcatcttccccccctccgac

SEQ ID NO: 19454 - RNA, 366 nt, synthetic construct
  misc_feature 1..366: note = derived and/or modified sequence opt2 from anti-HIV_Chain
  source 1..366: mol_type = other RNA
gagatcgtcctcacccagtcccccggcaccctctccctctcccccggcgagcgcgccaccctctcctgccgcgcctcccagtccatctcctccaactacctcgcctggtaccagcagaagcccggccaggccccccgcctcctcatctacggcgcctccacccgcgccaccggcatccccgaccgcttctccggctccggctccggcaccgacttcaccctctccatctcccgcctcgagcccgaggacatcgccgtctactactgccaccagtacggctcctcccagcgcttcggccagggcaccaaggtcgagatcaagcgcaccgtcgccgccccctccgtcttcatcttccccccctccgac

SEQ ID NO: 19455 - RNA, 366 nt, synthetic construct
  misc_feature 1..366: note = derived and/or modified sequence opt2 from anti-HIV_Chain
  source 1..366: mol_type = other RNA
gagatcgtcatgacccagtcccccgccaccctctccgtctcccccggcgaccgcgccaccctctcctgccgcgcctcccagtccgtctccaccaacctcgcctggtaccagcagaagcccggccaggccccccgcctcctcatctacggcgcctccacccgcgccaccggcatccccgccaccttctccggctccggcttcgccaccgagttcaccctcaccatctcctccctccagtccgaggacttcgccgtctactactgccagcagtacaacaactggccccccgccttcggccagggcaccaaggtcgagatcaagcgcaccgtcgccgccccctccgtcttcatcttccccccctccgac

SEQ ID NO: 19456 - RNA, 366 nt, synthetic construct
  misc_feature 1..366: note = derived and/or modified sequence opt2 from anti-HIV_Chain
  source 1..366: mol_type = other RNA
gacatccagatgacccagtcccccgcctccctctccgcctccgtcggcgaccgcgtcaccatcacctgccgcgcctcccagggcatctcccactacctcgcctggtaccagcagaagcccggcaaggtcccccgcctcctcatctacgccgcctcccgcctccagtccggcgtcacctcccgcttctccggctccggctccggcaccgagttcaccctcaccatctcctccctcctccccgaggacgccgccgtctacttctgccagaagtacgacaccgaccccatgaccttcggccagggcacccgcctcgagatcaagcgcaccgtcgccgccccctccgtcttcatcttccccccctccgac

SEQ ID NO: 19457 - RNA, 366 nt, synthetic construct
  misc_feature 1..366: note = derived and/or modified sequence opt2 from anti-HIV_Chain
  source 1..366: mol_type = other RNA
cagtccgccctcacccagcccccctccgcctccggcgcccccggccagcgcgtcaccatctcctgctccggcggcccctccaacgtcggcggcaactacgtctactggtaccgccagttccccggcaccgcccccaacctcctcatcctccgcgacgaccagcgcccctccggcgtccccgaccgcttctccgcctccaagtccggcaactccgcctccctcgccatctccggcctccgccccgacgacgaggccttctacttctgcgccacctacgactccgacggctccatccgcctcttcggcggcggcaccaccctcaccgtcctctcccagcccaaggccgccccctccgtcaccctcttc

SEQ ID NO: 19458 - RNA, 366 nt, synthetic construct
  misc_feature 1..366: note = derived and/or modified sequence opt2 from anti-HIV_Chain
  source 1..366: mol_type = other RNA
gacatccagatgacccagtccccctcctccctctccgcctccgtcggcgaccgcgtcaccatcaactgccaggccggccagggcatcggctcctccctcaactggtaccagaagaagcccggccgcgcccccaagctcctcgtccacggcgcctccaacctccagcgcggcgtcccctcccgcttctccggctccggcttccacaccaccttcaccctcaccatctcctccctccagcccgacgacgtcgccacctacttctgcgccgtcttccagtggttcggccccggcaccaaggtcgacatcaagcgcaccgtcgccgccccctccgtcttcatcttccccccctccgacgagcagctcaag

SEQ ID NO: 19459 - RNA, 366 nt, synthetic construct
  misc_feature 1..366: note = derived and/or modified sequence opt2 from anti-HIV_Chain
  source 1..366: mol_type = other RNA
gacatccagatgacccagtccccctcctccctctccgcctccgtcggcgaccgcgtcaccatcacctgccaggcctcccagggcatcggctcctccctccagtggtaccagcagaagcccggccgcgcccccaacctcctcgtccacggcgcctccaagctccaccgcggcgtcccctcccgcttctccggctccggcttccacaccaccttctccctcaccatctccggcctccagcgcgacgacttcgccacctacttctgcgccgtcctcgagttcttcggccccggcaccaaggtcgagatcaagcgcaccgtcgccgccccctccgtcttcatcttccccccctccgacgagcagctcaag

SEQ ID NO: 19460 - RNA, 366 nt, synthetic construct
  misc_feature 1..366: note = derived and/or modified sequence opt2 from anti-HIV_Chain
  source 1..366: mol_type = other RNA
caggtccacctcgtccagtccggcgccgaggtcaagaagcccggcgcctccgtcaaggtctcctgcaaggtctccggctacaccctctccgagctctccatccactgggtccgccagggccccggccgcggcctcgagtggatggccaacttcgaccccgaggacggcgagaccatctacgccccccagttccagggccgcgtcaccctcaccgaggacacctccaccgacaccgcctacatgcagctcacctccctccgctccgaggacaccgccgtctactactgcgccaccgaccgctacaccgacaccggccgctggggccccggcaccctcgtcaccgtctcctccgcctccaccaagggc

SEQ ID NO: 19461 - RNA, 366 nt, synthetic construct
  misc_feature 1..366: note = derived and/or modified sequence opt2 from anti-HIV_Chain
  source 1..366: mol_type = other RNA
caggtccagctcgtcgagtccggcggcggcctcatccagcccggcggctccctccgcctctcctgcgaggcctccggcttcgccgtcggcgacatcaactacatgtcctgggtccgccaggcccccggcaagggcctcgagtgggtctccgtcctctactccggcggctcctcccagtacgccgactccgtcaagggccgcttcaccatctcccgcgacaactcccgcaacaccctctacctccagatggacaacctccgcgccgaggacaccgccgtctactactgcgcccgcggcctccgcgtctacttcgacctctggggccagggcatcctcgtcaccgtctcctccgcctccaccaagggc

SEQ ID NO: 19462 - RNA, 366 nt, synthetic construct
  misc_feature 1..366: note = derived and/or modified sequence opt2 from anti-HIV_Chain
  source 1..366: mol_type = other RNA
caggtccagatggtcgcctccggcggcggcctcgtcaagcccggcggctccctccgcctctcctgcgaggcctccggcttcaccttctccgactactacatgtcctgggtccgccaggcccccggcaagggcctcgagtggatctcctacatcacctccggcggcaacgccctctactacgccgactccgtcaagggccgcttcaccatctcccgcgacaacgccaagaactccctctacctccagatgaactccctccgcgccgaggacaccgccgtctactactgcgcccgcgacctcctccacgcccacgacttcggccgccagggcaccctcgtcaccgtctcctccgcctccaccaagggc

SEQ ID NO: 19463 - RNA, 366 nt, synthetic construct
  misc_feature 1..366: note = derived and/or modified sequence opt2 from anti-HIV_Chain
  source 1..366: mol_type = other RNA
cagctccagctcgtcgagtccggcggcggcgtcgtccagcccggccgctccctccgcctctcctgcgccgcctccggcttcaccttctccacctacaccatgcactgggtccgccaggcccccggcaagggcctcgagtgggtcgccgtcatctcctacgacggcaccaacaagtactacgccgactccgtcaagggccgcttcaccatctcccgcgacaactccaagaacaccctctacctccagatgaactccctccgcggcgaggacaccgccgtctactactgcgcccgctccccctcctactacttcgactactggggccagggcaccctcgtcaccgtctccgccgcctccaccaagggc

SEQ ID NO: 19464 - RNA, 369 nt, synthetic construct
  misc_feature 1..369: note = derived and/or modified sequence opt2 from anti-HIV_Chain
  source 1..369: mol_type = other RNA
caggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcgtctccctcacccgccaggcctcctgggacttcgacacctactccttctacatggacctcaaggccgtccgctccgacgacaccgccatctacttctgcgcccgccagcgctccgacttctgggacttcgacgtctggggctccggcacccaggtcaccgtctcctcc

SEQ ID NO: 19465 - RNA, 369 nt, synthetic construct
  misc_feature 1..369: note = derived and/or modified sequence opt2 from anti-HIV_Chain
  source 1..369: mol_type = other RNA
caggtccagctcctccagtccggcgccgtcgtcaccaagcccggcgcctccgtccgcgtctcctgcgaggcctccggctacaagatccgcgactacttcatccactggtggcgccaggcccccggccagggcctccagtgggtcggctggatcaacccccagaccggccagcccaacatcccccgccccttccagggccgcgtcaccctcacccgccacgcctcctgggacttcgacaccttctccttctacatggacctcaaggccctccgctccgacgacaccgccatctacttctgcgcccgccgccgctccgactactgcgacttcgacgtctggggctccggcacccacgtcaccgtctcctcc

SEQ ID NO: 19466 - RNA, 369 nt, synthetic construct
  misc_feature 1..369: note = derived and/or modified sequence opt2 from anti-HIV_Chain
  source 1..369: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccacgcctcctgggacttcgacaccttctccttctacatggacctcaagggcctccgctccgacgacaccgccatctacttctgcgcccgccagcgctccgactactgggacttcgacgtctggggctccggcacccaggtcaccgtctcctcc

SEQ ID NO: 19467 - RNA, 369 nt, synthetic construct
  misc_feature 1..369: note = derived and/or modified sequence opt2 from anti-HIV_Chain
  source 1..369: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgcctcttccagggccgcgtctccctcacccgccacgcctcctgggacttcgacaccttctccttctacatggacctcaaggccgtccgctccgacgacaccgccgtctacttctgcgcccgccagcgctccgactactgggacttcgacgtctggggctccggcacccaggtcaccgtctcctcc

SEQ ID NO: 19468 - RNA, 369 nt, synthetic construct
  misc_feature 1..369: note = derived and/or modified sequence opt2 from anti-HIV_Chain
  source 1..369: mol_type = other RNA
caggtccgcctcctccagtccggcgccgccgtcaccaagcccggcgcctccgtccgcgtctcctgcgaggcctccggctacgagatccgcgactacttcatccactggtggcgccaggcccccggccagggcctccagtgggtcggctggatcaaccccaagaccggccagcccaacaacccccgccagttccagggccgcgtctccctcacccgccaggcctcctgggacttcgactcctactccttctacatggacctcaaggccctccgctccgacgacaccggcgtctacttctgcgcccgccagcgctccgactactgggacttcgacgtctggggctccggcacccaggtcaccgtctcctcc

SEQ ID NO: 19469 - RNA, 369 nt, synthetic construct
  misc_feature 1..369: note = derived and/or modified sequence opt2 from anti-HIV_Chain
  source 1..369: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccacgcctcctgggacttcgacaccttctccttctacatggacctcaaggccctccgctccgacgacaccgccgtctacttctgcgcccgccagcgctccgactactgggacttcgacgtctggggctccggcacccaggtcaccgtctcctcc

SEQ ID NO: 19470 - RNA, 369 nt, synthetic construct
  misc_feature 1..369: note = derived and/or modified sequence opt2 from anti-HIV_Chain
  source 1..369: mol_type = other RNA
gaggtccagctcgtcgagtccggcggcggcctcatccagcgcggcggctccctccgcctctcctgcgtcgcctccggcttccccgtctccgacaaccacatgtcctgggtccgccaggcccccggcaagggcctcgagtgggtctccatcatctactccgacggcggcacctactacgccgactccgtcaagggccgcttcaccatctcccgcgacaactccaagaacaccgtctacctccagatgaactccctccgcgccaccgacaccgccgtctactactgcgcccgcgaccccggcttccactacggcctcgacgtctggggccagggcaccaccgtcaccgtctcctccgcctccaccaagggc

SEQ ID NO: 19471 - RNA, 369 nt, synthetic construct
  misc_feature 1..369: note = derived and/or modified sequence opt2 from anti-HIV_Chain
  source 1..369: mol_type = other RNA
caggtccagctccaggagtccggccccggcctcctccgccccctcgagaccctctccctcacctgctccgtctccggcggctccatccgcggctacttctggtcctgggtccgccagcccgccggccgcggcctcgagtggatcggccgcatctactcctccggcaccacccgcttcaacccctccctcaagtcccgcgtccgcctctccatcgacaccgccaagtccgaggtctccctcaacatcacctccgtcaccgccgccgactccgcctcctacttctgcgccggcacctcccccgtccacggcggcctcgacctctggggcctcggcctccgcgtcaccgtctcctccgcctccaccaagggc

SEQ ID NO: 19472 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccggcaccctctccctctcccccggcgagcgcgccaccctctcctgccgcgcctcccagtccgtctcctccaacctcgcctggtacgcccagaagcccggccaggccccccgcctcatcatctacggcgcctcctcccgcgcctccgccatccccgaccgcttccgcggctccggctccggcaccgacttcaccctcaccatctcccgcctcgagcccgaggacttcgccgtctactactgccagcagtacgacgacgcccccatcaccttcggccacggcacccgcctcgagatcaagcgcaccgtcgccgccccctccgtcttcatcttccccccctccgacgag

SEQ ID NO: 19473 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccggcaccctctccctctcccccggcgaccgcgccgccctctcctgccgcgcctccgagaccctctccggcaactccctcgcctggtaccagcagaagcgcggccagcccccccgcctcctcatcttcgccgcctcctcccgcgccaccggcatccccgagcgcttctccggcggcggctccggcaccgacttcaccctcaccatcacccgcctcgagcccgaggacttcgccgtctacttctgccagcagtacgtcgacgcccccatcaccttcggccagggcacccgcctcgagatcaagcgcaccgtcgccgccccctccgtcttcatcttccccccctccgac

SEQ ID NO: 19474 - RNA, 369 nt, synthetic construct
  misc_feature 1..369: note = derived and/or modified sequence opt2 from anti-HIV_Chain
  source 1..369: mol_type = other RNA
gacatccagatgacccagtccccctcctccctctccgcctccgtcggcgaccgcgtcaccatcacctgccgcgcctcccaggacatcaccacctacctcgcctggctccagcagaagcccggcaaggcccccaagtccctcatctactccgcctccaccgtccagtccggcgtcccctcccgcttctccggctccggctccggcaccgagttcaccctcaccatctccggcctccagcccgaggacttcgccacctactactgccagcagtacaactactaccccatcaccttcggcctcggcacccgcctcgagatcaagcgcaccgtcgccgccccctccgtcttcatcttccccccctccgacgag

SEQ ID NO: 19475 - RNA, 369 nt, synthetic construct
  misc_feature 1..369: note = derived and/or modified sequence opt2 from anti-HIV_Chain
  source 1..369: mol_type = other RNA
gacatccagatgacccagtccccctcctccctctccgcctccatcggcgaccgcgtcaccatcacctgccgcgccaaccagcacatccgctccttcctcaactggtaccagcagacccccggcaaggcccccaagctcctcatctacgccgcctccaccctccagcgcggcgtcccctcccgcttctccggctccggctccggcaccgacttcaccctcaccatcacctccctcgagcgcgaggacctcgccacctactactgccagcagacctacacctcccccatcaccttcggccagggcacccgcctcgagatcaagcgcaccgtcgccgccccctccgtcttcatcttccccccctccgacgag

SEQ ID NO: 19476 - RNA, 369 nt, synthetic construct
  misc_feature 1..369: note = derived and/or modified sequence opt2 from anti-HIV_Chain
  source 1..369: mol_type = other RNA
tccgagatcgtcctcacccagtcccccgccaccctctccctctcccccggcgagtccgccaccctctcctgccgcgcctcccagtccctctcctcctccctcgcctggtaccagcagaagcccggccaggccccccgcctcctcatctacgacacctccgaccgcgccaccggcatccccgcccgcttctccggccgcggctccggcaccgacttcaccctcaccatctcctccctcgagcccgaggacttcgccgtctactactgccagcagcgctccaactgggccatcaccttcggccagggcacccgcctcgagatcaagcgcaccgtcgccgccccctccgtcttcatcttccccccctccgac

SEQ ID NO: 19477 - RNA, 369 nt, synthetic construct
  misc_feature 1..369: note = derived and/or modified sequence opt2 from anti-HIV_Chain
  source 1..369: mol_type = other RNA
caggtcctctccgtctccggcacccccggccagcgcgtcatcatctcctgctccggcacctcctccaacgtcggcggcaacctcgtctcctggtaccagcacctccccggcgccgccccccgcctcctcatccaccgcgacgaccagcgcccctccggcgtccccgaccgcttctccggctccaagtccggcaactccgcctccctcgtcatctccggcctccgctccgacgacgaggccgactacttctgcgccgcctacgactccaccttctccctccccgtcttcggcggcggcacccgcctcaccgtcctctcccagcccaaggccgccccctccgtcaccctctacgccccctcctccgaggag

SEQ ID NO: 19478 - RNA, 369 nt, synthetic construct
  misc_feature 1..369: note = derived and/or modified sequence opt2 from anti-HIV_Chain
  source 1..369: mol_type = other RNA
gacatccagatgacccagtccccctcctccctctccgcctccgtcggcgaccgcgtcaccatcacctgccaggccggccagggcatcggctcctccctccagtggtaccagcagaagcccggcaaggcccccaagctcctcgtccacggcgcctccaacctccaccgcggcgtcccctcccgcttctccggctccggcttccacaccaccttctccctcaccatctccggcctccagcgcgacgacttcgccacctacttctgcgccgtcctcgagttcttcggccccggcaccaaggtcgagatcaagcgcaccgtcgccgccccctccgtcttcatcttccccccctccgacgagcagctcaagtcc

SEQ ID NO: 19479 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccgccaccctctccctctcccccggcgagcgcgccaccctctcctgccgcgcctcccagggcctcaacttcgtcgtctggtaccagcagaagcgcggccaggccccccgcctcctcatccacgccccctccgaccgcgcccccggcgtccccgaccgcttctccgcccgcggctccggcaccgacttctccctcgtcatctcctccgtcgagcccgacgacttcgccatctactactgccaggagtactcctccaccccctacaacttcggccccggcacccgcgtcgaccgcaagcgcaccgtcgccgccccctccgtcttcatcttccccccctccgacgagcag

SEQ ID NO: 19480 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccaccaccctctccctctcccccggcgagcgcgccaccctctcctgccgcgcctcccagggcgtcaacctcgtcgtctggtaccagcagaagcgcggccaggccccccgcctcctcatctacggcccctccgaccgcgcccccggcgtccccgaccgcttctccgcccgcggctccggcaccgagttctccctcgtcatctcctccgtcgagcccgacgacttcgccctctactactgccaggagtactcctccaccccctacaacttcggcaccggcacccgcgtcgaccgcaagcgcaccgtcgccgccccctccgtcttcatcttccccccctccgacgagcag

SEQ ID NO: 19481 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccgccaccctctccctctcccccggcgagcgcgccaccctctcctgccgcgcctcccagggcgtcaacttcgtcgtctggtaccagcagaagcgcggccaggccccccgcctcctcatctacggcccctccaaccgcgcccccggcgtccccgaccgcttctccgcccgcggctccggcaccgagttctccctcgtcatctcctccgtcgagcccgacgacttcgccctctactactgccaggagtactcctccaccccctacaacttcggccccggcacccgcgtcgaccgcaagcgcaccgtcgccgccccctccgtcttcatcttccccccctccgacgagcag

SEQ ID NO: 19482 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccgccaccctctccctctcccccggcgagcgcgccaccctctcctgccgcgcctcccagggcctcaacttcgtcgtctggtaccagcagaagcgcggccaggccccccgcctcctcatccacggcccctcccaccgcgcccccggcgtccccgaccgcttctccgcccgcggctccggcaccgagttctccctcgtcatctcctccgtcgagcccgacgacttcgccatctactactgccaggagtactcctccaccccctacaacttcggccccggcacccgcgtcgaccgcaagcgcaccgtcgccgccccctccgtcttcatcttccccccctccgacgagcag

SEQ ID NO: 19483 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccgccaccctctccctctcccccggcgagcgcgccaccctctcctgccgcgcctcccagggcctcaacttcgtcgtctggtaccagcagaagggcggccaggccccccgcctcctcatccacggccccaccgaccgcgcccccggcgtccccgaccgcttctccgcccgcggctccggcaccgagttctccctcgtcatctcctccgtcgagcccgacgacttcgccctctactactgccaggagtactcctccaccccctacaacttcggccccggcacccgcgtcgaccgcaagcgcaccgtcgccgccccctccgtcttcatcttccccccctccgacgagcag

SEQ ID NO: 19484 - RNA, 369 nt, synthetic construct
  misc_feature 1..369: note = derived and/or modified sequence opt2 from anti-HIV_Chain
  source 1..369: mol_type = other RNA
gagatcgtcctcacccagtcccccgccaccctctccctctcccccggcgagcgcgccaccctctcctgccgcgcctcccagggcctcaacttcgtcgtctggtaccagcagaagcgcggccaggccccccgcctcctcatccacgccccctccggccgcgcccccggcgtccccgaccgcttctccgcccgcggctccggcaccgagttctccctcgtcatctcctccgtcgagcccgacgacttcgccatctactactgccaggagtactcctccaccccctacaacttcggccccggcacccgcgtcgaccgcaagcgcaccgtcgccgccccctccgtcttcatcttccccccctccgacgagcag

SEQ ID NO: 19485 - RNA, 369 nt, synthetic construct
  misc_feature 1..369: note = derived and/or modified sequence opt2 from anti-HIV_Chain
  source 1..369: mol_type = other RNA
caggtccagctcgtccagtccggcgccgaggtcaagaagcccggctcctccgtcaaggtctcctgcaagacctccggcggctccttctccaactacgccttctcctgggtccgccaggcccccggcgagggcctcgagtggatgggccgcatcatccccatcttcggcaccgccaagtacacccagaagctccagggccgcgtcaccatcaccgccgacaagttcacctccaccgtctacatggagctctcctccctccgctccgaggacaccgccatctactactgcgcctccctccaccagggccccatcggctacaccccctggcacccccccccccgcgcccccctcggccagtccgtctgcggc

SEQ ID NO: 19486 - RNA, 369 nt, synthetic construct
  misc_feature 1..369: note = derived and/or modified sequence opt2 from anti-HIV_Chain
  source 1..369: mol_type = other RNA
caggtccagctcgtcgagtccggcggcggcctcgtccagcccggcggctccctccgcatctcctgctccgccaccggcttcaccttctccacccacgccatgcactgggtccgccaggcccccggcaagggcctcgagtacgtctccgccatcaactccaacggccgctccgccttctacgccgactccgtcaagggccgcgtcaccatctcccgcgacaactccaagaacaccctcttcctccagatgacctccctccgcgccgaggacaccgccgtctactactgcgtcaagggccccctcctccgctacctcgactcctggggccagggcaccctcgtcaccgtctcctccgcctccaccaagggc

SEQ ID NO: 19487 - RNA, 369 nt, synthetic construct
  misc_feature 1..369: note = derived and/or modified sequence opt2 from anti-HIV_Chain
  source 1..369: mol_type = other RNA
gaggtccagctcgtcgagtccggcggcggcctcgtccagcccggcggctccctccgcatctcctgctccgccaccggcttcaccttctccacccacgccatgcactgggtccgccaggcccccggcaagggcctcgagtacgtctccgccatcaactccaacggccgctccgccttctacgccgactccgtcaagggccgcgtcaccatctcccgcgacaactccaagaacaccctcttcctccagatgacctccctccgcgccgaggacaccgccgtctactactgcgtcaagggccccctcctccgctacctcgactcctggggccagggcaccctcgtcaccgtctcctccgcctccaccaagggc

SEQ ID NO: 19488 - RNA, 369 nt, synthetic construct
  misc_feature 1..369: note = derived and/or modified sequence opt2 from anti-HIV_Chain
  source 1..369: mol_type = other RNA
gaggagtccggccccggcctcgtcaagccctcccagaccctctccctcacctgctccgtctccggcgactccgtctcctccggcggctacttctggtcctggatccgccagcaccccaccaagggcctcgagtgcctcggctacgtctactacaccggcaacacctactacaacccctccctcaagtccccccccaccatcgaggtcgccatggccaacaaccaggtctccctcaagctcggctccgtcaccgccgccgacaccgccgtctactactgcgcccgcatcaagcgcttccgcggcggcaactacttcgacacctggggccacggcctcctcgtcaccgtctcctccgcctccaccaagggc

SEQ ID NO: 19489 - RNA, 369 nt, synthetic construct
  misc_feature 1..369: note = derived and/or modified sequence opt2 from anti-HIV_Chain
  source 1..369: mol_type = other RNA
caggtccagctccaggagtccggctccggcctcgtcaagccctccggcaccctctccctcacctgcgccgtctccaacggccccatctcctccggcaactggtggtcctgggtccgccagacccccgagaagggcctcgagtggatcggcgaggtctaccactccggctccaccaaccacaacccctccctcaagtcccgcgccaccatcctcgtcgacaagtccaagaaccagttctccctcaacctccgctccgtcaccgccgccgacaccgccgtctactactgcgcccgcgtccgcggctcctggaacttcgactactggggccagggcatcctcgtcaccgtctcctccgcctccaccaagggc

SEQ ID NO: 19490 - RNA, 369 nt, synthetic construct
  misc_feature 1..369: note = derived and/or modified sequence opt2 from anti-HIV_HeavyChain
  source 1..369: mol_type = other RNA
gaggtccagctccagcagtccggcaccgtcctcgcccgccccggcgcctccgtcaagatgtcctgcaaggcctccggctacaccttcacctcctactggatgcactgggtcaagcagcgccccggccagggcctcgagtggatcggcgccatctaccccggcaactccgacacctcctacaaccagaagttcaagggcaaggccaagctcaccgccgtcacctccgcctccaccgcctacatggagctctcctccctcaccaacgaggactccgccgtctactactgcacccgctggccccactactacggcggctcccgctactacttcgactactggggccagggcaccaccctcaccgtctcctcc

SEQ ID NO: 19491 - RNA, 372 nt, synthetic construct
  misc_feature 1..372: note = derived and/or modified sequence opt2 from anti-HIV_Chain
  source 1..372: mol_type = other RNA
gtcgtccagctcgtcgagtccggcggcggcctcgtccagcccggcggctccctccgcctctcctgcgccgcctccggcttcgccttccgctcctactggatgtcctgggtccgccaggcccccggccgcggcctcgagtgggtcgccaacatcaagcaggacggctccgagaagtactacgccgactccgtcaagggccgcttcaccatctcccgcgacaacaccaagaactccctctacctccagatgaactccctccgcgccgaggacaccgccgtcttctactgcgcctcccgcggcgaccgctacggccccatcgactactggggccagggcaccctcgtcaccgtctcctccgcctccaccaagggc

SEQ ID NO: 19492 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgagatcaagaagcccggcgagtccctcaagatctcctgcaaggcctccggctacaccttcaacgactactggatcggctgggtccgccagatgcccggcaagggcctcgagtggatgggcatcttctaccccgacgactccgactccaactactccccctccttccagggccgcgtcaccatctccgccgacaagtccatcaccaccgcctacctccagtggtccaccctcaaggcctccgactccgccatgtacttctgcgcccgcctcctcggcgactccggcgccttcgacatctggggccagggcaccatggtcatcgtctcctccgcctccaccaagggc

SEQ ID NO: 19493 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcggcggcctcgtcaagcccggcggctccctccgcctctcctgcgccgcctccggcttcaccttctcctcctactccatgaactgggtccgccaggcccccggcaagggcctcgagtgggtctcctccatctcctcctcctcctcctacatctactacgccgactccgtcaagggccgcttcaccatctcccgcgacaacgccaagaactccctctacctccagatgaactccctccgcgccgaggacaccgccgtctactactgcgcccgcgagggctcctactactacggcatggacgtctggggccagggcaccaccgtcaccgtctcctccgcctccaccaagggc

SEQ ID NO: 19494 - RNA, 372 nt, synthetic construct
  misc_feature 1..372: note = derived and/or modified sequence opt2 from anti-HIV_Chain
  source 1..372: mol_type = other RNA
gagatcgtcctcacccagtcccccgccaccctctccgtctcccccggcgagcgcgccaccctctcctgccgcgccggccagtccgtctcctccgacctcgcctggtaccagcacaagcccggccaggccccccgcctcctcatctacgacgcctccaagcgcgccaccggcatccccgcccgcttctccggctccggctccggcaccgacttcaccctcaccatctcctccctcgagcccgaggacttcgccgtctactactgccagcaccgcaccaactggcccccctccatcaccttcggccagggcacccgcctcgagatcaagcgcaccgtcgccgccccctccgtcttcatcttccccccctccgac

SEQ ID NO: 19495 - RNA, 372 nt, synthetic construct
  misc_feature 1..372: note = derived and/or modified sequence opt2 from anti-HIV_Chain
  source 1..372: mol_type = other RNA
gagatcgtcctcacccagtcccccggcaccctctccctctcccccggcgagcgcgccaccctctcctgccgcgcctcccagtccgtctcctcccgctacctcgcctggtaccagcagaagcccggccaggccccccgcctcatcatctacgacgcctcctcccgcgcctccggcatccccgaccgcttctccggctccggctccgagaccgacttcaccctcaccatcacccgcctcgagcccgaggacttcgccgtctactactgccagctctacggcacctcccccaagttcaccttcggccagggcaccaagctcgagatcaagcgcaccgtcgccgccccctccgtcttcatcttccccccctccgac

SEQ ID NO: 19496 - RNA, 372 nt, synthetic construct
  misc_feature 1..372: note = derived and/or modified sequence opt2 from anti-HIV_Chain
  source 1..372: mol_type = other RNA
gagatcgtcctcacccagtcccccggcaccctctccctctcccccggcgagcgcgccaccctctcctgccgcgcctcccagtccgtctccaacaactacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacgccacctcctccctctacaccttcggccagggcaccaagctcgagatcaagcgcaccgtcgccgccccctccgtcttcatcttccccccctccgac

SEQ ID NO: 19497 - RNA, 372 nt, synthetic construct
  misc_feature 1..372: note = derived and/or modified sequence opt2 from anti-HIV_Chain
  source 1..372: mol_type = other RNA
cccgccaccctcgccgtctcccccggcgagcgcgccaccatctcctgcaagtcctcccagaacctcctctactccgccaacaaccagcactccctcgcctggtaccagcagcgccccggccagccccccaagctcctcctctactgggcctccacccgcctctccggcgtccccgaccgcttctccggctccggctccggcaccgacttcaccctcaccatctccaacctccaggccgaggacgtcgccgtctactactgccagcagtactactcccccccccccaccttcggccagggcaccaaggtcgagatccgccgcaccgtcgccgccccctccgtcttcatcttccccccctccgacgagcagctc

SEQ ID NO: 19498 - RNA, 372 nt, synthetic construct
  misc_feature 1..372: note = derived and/or modified sequence opt2 from anti-HIV_Chain
  source 1..372: mol_type = other RNA
cagcccgtcctcacccagcccccctccgcctccggcgcccccggccagcgcgtcaccatctcctgctccggcggcccctccaacgtcggcggcaactacgtctactggtaccgccagttccccggcaccgcccccaacctcctcatcctccgcgacgaccagcgcccctccggcgtccccgaccgcttctccgcctccaagtccggcaactccgcctccctcgccatcaccggcctccgccccgacgacgaggccttctacttctgcgccacctacgactccgacggctccatccgcctcttcggcggcggcaccgccctcaccgtcctctcccagcccaaggccgccccctccgtcaccctcttccccccc

SEQ ID NO: 19499 - RNA, 372 nt, synthetic construct
  misc_feature 1..372: note = derived and/or modified sequence opt2 from anti-HIV_Chain
  source 1..372: mol_type = other RNA
aacttcatgctcacccagcccccctccgcctccggcgcccccggccagcgcgtcaccatctcctgctccggcggcccctccaacgtcggcggcaactacgtctactggtaccgccagttccccggcaccgcccccaacctcctcatcctccgcgacgaccagcgcccctccggcgtccccgaccgcttctccgcctccaagtccggcaactccgcctccctcgccatctccggcctccgccccgacgacgaggccttctacttctgcgccacctacgactccgacggctccatccgcctcttcggcggcggcaccaccctcaccgtcctctcccagcccaaggccgccccctccgtcaccctcttccccccc

SEQ ID NO: 19500 - RNA, 372 nt, synthetic construct
  misc_feature 1..372: note = derived and/or modified sequence opt2 from anti-HIV_Chain
  source 1..372: mol_type = other RNA
gacatccagatgacccagtcccccccctccctctccgcctccgtcggcgaccgcgtcaccatcacctgccaggcctcccaggacatcaacaacttcctcaactggtaccagcagaagcccggcaaggccccccgcctcctcatctacgacgcctccaacctcgagtccggcgtctcctcccgcttctccggctcccgctccggcaccgacttcaccctcaccatctcctccctcctccccgaggacatcgccacctactcctgccagcagtactccaacctcccctacaccttctcccagggcaccaagctcgagatcaagcgcaccgtcgccgccccctccgtcttcatcttccccccctccgacgagcag

SEQ ID NO: 19501 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcaccgccgtcaagcgccccggcgcctccgtccgcgtctcctgccaggcctccggctacaccttcatcgaccacttcatctactggtggcgccaggcccccggccagggcctcgagtggctcggctggatcaaccccctcacctcccagccctcctacccctcccgcttccagggccgcctcaccctcacccgcgacaccttcgacgagatgctctacatggacctccgcggcctccgctccgacgacaccggcatctacttctgcgcccgccgccactccgactactgcgacttcgacatctggggctccggcacccagatcatcgtctcctccgcctccaccaagggc

SEQ ID NO: 19502 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccaggcctacggctacaagttcaccgaccacctcatctactggtggcgccaggcccccggccagggcctcgagtggatcggctggatcaagcccgagaccggccagccctcctactcctacaagttccagggccgcgtctccctcacccgcgacaccttccaggagatcctcttcatggacctccgcggcctccgctccgacgacaccgccatctacttctgcgcccgccgccactccgactactgcgacttcgacgtctggggctccggctcccaggtcatcgtctcctccgcctccaccaagggc

SEQ ID NO: 19503 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccagacctacggctacaagttcaccgaccacctcatctactggtggcgccaggcccccggccagggcctcgagtggatgggctggatcaagcccgagaccggccagccctcctactcctaccgcttccagggccgcgtctccctcacccgcgacaccttcgaggagatcgtcttcatggacctccgcggcctccgctccgacgacaccgccatctacttctgcgcccgccgccactccgactactgcgacttcgacgtctggggctccggctcccaggtcatcgtctcctccgcctccaccaagggc

SEQ ID NO: 19504 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccagacctacggctacaagttcaccgaccacctcatctactggtggcgccaggcccccggccagggcctcgagtggatcggctggatcaagcccgagaccggccagccctcctactcctaccgcttccagggccgcgtctccctcacccgcgacaccttcgaggagatcgccttcatggacctccgcggcctccgctccgacgacaccgccatctacttctgcgcccgccgccacaccgactactgcgtcttcgacgtctggggctccggctcccagatcatcgtctcctccgcctccaccaagggc

SEQ ID NO: 19505 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcaccgccgtcaagcgccccggcgcctccgtccgcgtctcctgccaggcctccggctacaccttcaccgactacttcatctactggtggcgccaggcccccggccagggcctcgagtggctcggctggatcaaccccctcacctcccagccctcctacccctcccgcttccagggccgcctcaccctcacccgcgacaccttcgacgagatgctctacatggacctccgcggcctccgctccgacgacaccggcatctacttctgcgcccgccgccactccgactactgcgacttcgacatctggggctccggcacccagatcatcgtctcctccgcctccaccaagggc

SEQ ID NO: 19506 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccgtccgcatctcctgccaggcctacggctacaagttcaccgaccacctcatctactggtggcgccaggcccccggccagggcctcgagtggatcggctggatcaagcccgagaccggccagccctcctacgcctacaagttccagggccgcgtcaccctcacccgcgacaccttcgaggagatccacttcatggacctccgcggcgtccgcaacgacgacaccgccacctacttctgcgcccgccgccactccgactactgcgacttcgacgtctggggctccggctcccaggtcatcgtctcctccgcctccaccaagggc

SEQ ID NO: 19507 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccgtccgcatctcctgccagacctacggctacaagttcaccgaccacctcatctactggtggcgccaggcccccggccagggcctcgagtggatcggctggatcaagcccgagaccggccagccctcctactcctaccgcttccagggccgcgtctccctcacccgcgacaccttcgaggagatcgtcttcatggacctccgcggcctccgctccgacgacaccgccatctacttctgcgcccgccgccactccgactactgcgacttcgacgtctggggctccggctcccaggtcctcgtctcctccgcctccaccaagggc

SEQ ID NO: 19508 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccagacctacggctacaagttcaccgaccacctcatctactggtggcgccaggcccccggccagggcctcgagtggatcggctggatcaagcccgagaccggccagccctcctactcctaccgcttccagggccgcgtctccctcacccgcgacaccttcgaggagatcgtcttcatggacctccgcggcctccgctccgacgacaccgccatctacttctgcgcccgccgccactccgactactgcgacttcgacgtctggggctccggctcccaggtcctcgtctcctccgcctccaccaagggc

SEQ ID NO: 19509 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccgtccgcatctcctgccagacctacggctacaagttcaccgaccacctcatccactggtggcgccaggcccccggccagggcctcgagtggatcggctggatcaagcccgacaccggccagccctcctactcctcccgcttccagggccgcgtctccctcacccgcgacaccttcgaggagatcgtcttcatggacctccgcggcctccgctccgacgacaccgccatctacttctgcgcccgccgccactccgactactgcgacttcgacgtctggggctccggctcccaggtcctcgtctcctccgcctccaccaagggc

SEQ ID NO: 19510 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccagacctacggctacaagttcaccgaccacctcatctactggtggcgccaggcccccggccagggcctcgagtggatcggctggatcaagcccgagaccggccagccctcctactcctaccgcttccagggccgcgtctccctcacccgcgacaccttcgaggagatcgtcttcatggacctccgcggcctccgctccgacgacaccgccatctacttctgcgcccgccgccactccgactactgcgacttcgacgtctggggctccggctcccaggtcatcgtctcctccgcctccaccaagggc

SEQ ID NO: 19511 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccagacctacggctacaagttcaccgaccacctcatctactggtggcgccaggcccccggccagggcctcgagtggatcggctggatcaagcccgagaccggccagccctcctactcctaccgcttccagggccgcgtctccctcacccgcgacaccttcgaggagatcgtcttcatggacctccgcggcctccgctccgacgacaccgccatctacttctgcgcccgccgccactccgactactgcgacttcgacgtctggggcggcggctcccaggtcatcgtctcctccgcctccaccaagggc

SEQ ID NO: 19512 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgcctcacctacggctacaagttcaccgaccacctcatctactggtggcgccaggcccccggccagggcctcgagtggatcggctggatcaagcccgagaccggccagccctcctactcctaccgcttccagggccgcgtctccctcacccgcgacaccttcgaggagatcgtcttcatggacctccgcggcctccgctccgacgacaccgccatctacttctgcgcccgccgccactccgactactgcgacttcgacgtctggggctccggctcccaggtcatcgtctcctccgcctccaccaagggc

SEQ ID NO: 19513 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccaccctcaagaagcccggcgcctccgtccgcatctcctgccaggcctacggctacaagttcaccgaccacctcatccactggtggcgccaggcccccggccagggcctcgagtggatcggctggatcaagcccgagaccggccagccctcctacgcctacaagttccagggccgcgtctccctcacccgcgacaccttcgaggagatcctcttcatggacctccgcggcctccgctccgacgacaccgccatctacttctgcgcccgccgccactccgactactgcgacctcgacgtctggggcggcggcacccagctcctcgtctcctccgcctccaccaagggc

SEQ ID NO: 19514 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccgtccgcatctcctgccaggcctacggctacaagttcaccgaccacctcatctactggtggcgccaggcccccggccagggcctcgagtggatcggctggatcaagcccgagaccggccagccctcctactcctacaagttccagggccgcgtcaccctcacccgcgacaccttcgaggagatccacttcatggacctccgcggcctccgctacgacgacaccgccacctacttctgcgcccgccgccactccgactactgcgacttcgacgtctggggctccggctcccaggtctccgtctcctccgcctccaccaagggc

SEQ ID NO: 19515 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccaggcctacggctacaagttcaccgaccacctcatctactggtggcgccaggcccccggccagggcctcgagtggatcggctggatcaagcccgagaccggccagccctcctactcctacaagttccagggccgcgtctccctcacccgcgacaccttccaggagatcctcttcatgaacctccgcggcctccgctccgacgacaccgccatctacttctgcgcccgccgccactccgactactgcgacttcgacgtctggggctccggctcccagatcctcgtctcctccgcctccaccaagggc

SEQ ID NO: 19516 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcaccgccgtcaagaagcccggcgcctccgtccgcgtctcctgccaggcctccggctacaccttcaccgactacttcatctactggtggcgccaggcccccggccagggcctcgagtggctcggctggatcaacccccgcacctcccagccctcctacccctaccgcttccagggccgcgtcaccctcacccgcgacatcttcgaggagatgctctacatggacctccgcggcctccgctccgacgacaccggcatctacttctgcgcccgccgccactccgactactgcgacttcgacatctggggctccggcacccagatcatcgtctcctccgcctccaccaagggc

SEQ ID NO: 19517 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgccctcaagaagcccggcgcctccctccgcatctcctgccaggcctacggctacaagttcaccgactacctcatccactggtggcgccaggcccccggccagggcctcgagtggatcggctggatcaagcccgagaccggccagccctcctactcctacaagttccagggccgcgtctccctcacccgcgacaccttcgaggagatcctcttcatggacctccgcggcctccgctccgacgacaccgccatctacttctgcgcccgccgccactccgactactgcgacttcgacgtctggggcggcggctcccaggtcctcgtctcctccgcctccaccaagggc

SEQ ID NO: 19518 - RNA, 372 nt, synthetic construct
  misc_feature 1..372: note = derived and/or modified sequence opt2 from anti-HIV_Chain
  source 1..372: mol_type = other RNA
gaggtccagctcctcgagtccggcggcgccctcgtccagcccggcggctccctccgcctctcctgcgccgcctccggcttcaccttctccacctcctccatgtcctgggtccgccaggcccccggcaagggcctcgagtgggtctccgccatcggctccggccgcggctccaccttctacgccgactccgtcaagggccgcttcaccatctcccgcgacaactccaagaacaccctctccctccagatgaactccctcaccgccgaggacaccgccacctactactgcaccaagaccggcggcctcctccgcttccccgaggtctggggcaagggcaccaccgtcaccgtctcctccgcctccaccaagggc

SEQ ID NO: 19519 - RNA, 372 nt, synthetic construct
  misc_feature 1..372: note = derived and/or modified sequence opt2 from anti-HIV_Chain
  source 1..372: mol_type = other RNA
gaggtccagctcgtcgagtccggcggcggcctcgtcaagcccggcggctccctccgcctctcctgcgccgactccggcttcaccttccgctcctactccatgcactgggtccgccaggcccccggcaagggcctcgcctgggtctcctccatctcctccacctccaactacatctactacgccgactccgtcaagggccgcttcaccatctcccgcgacaacgccaagaactccctctacctccagatgaactccctccgcgccgaggacaccgccgtctactactgcgcccgcaccttcatcaccgcctcctggttcgactcctggggccagggcaccctcgtcaccgtctcctccgcctccaccaagggc

SEQ ID NO: 19520 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgaggtcaagaagcccggcgcctccgtcaaggtctcctgcaaggcctccggctacaccttcaccaactacggcgtctcctgggtccgccaggcccccggccagggcctcgagtggatgggctggatctccccctactccggcaacaccaactacgcccagcgcctccaggaccgcgtcaccatgaccaccgacacctccaccaacaccgcctacatggagctccgctccctccgctccgacgacaccgccgtctactactgcgccgcccgctcctactactactactccatggacgtctggggccagggcaccaccgtcaccgtctcctccgcctccaccaagggc

SEQ ID NO: 19521 - RNA, 372 nt, synthetic construct
  misc_feature 1..372: note = derived and/or modified sequence opt2 from anti-HIV_Chain
  source 1..372: mol_type = other RNA
caggtccagctcgtccagtccggcgccgagctcaagaagcccggctcctccgtcaaggtctcctgcaaggcctccggcggcaccttctccaactacgccatcaactgggtccgccaggcccccggccagggcttcgagtggatgggcggcatcatccccctcttcgccacccccacctacgcccagaagttccagggccgcgtccgcatcaccgccgacgactccacctccaccgcctacatggagctctcctccctccgctccgacgacaccgccgtctacttctgcgcccgccccaacgtcgtccgctccgccctcgactactggggccagggcaccctcgtcaccgtctcctccgcctccaccaagggc

SEQ ID NO: 19522 - RNA, 372 nt, synthetic construct
  misc_feature 1..372: note = derived and/or modified sequence opt2 from anti-HIV_Chain
  source 1..372: mol_type = other RNA
caggtccagctcgtcgagtccggcggcggcgtcgtccagcccggcaagtccctccgcctctcctgcgccgcctccggcttcaccttctccacccacgccatgcactgggtccgccaggcccccggcaagggcctcgactgggtcgccgtcatctcccacgacggcgacaaccagtactacgccgacgccgtcaagggccgcttcaccatctcccgcgacgactcccgcgacaccgtcttcctccagatgaactccctccgcaccgaggacaccggcgtctactactgcgccgccgactcctccggctccaactggttcgactactggggccagggcatcctcgtcaccgtctcctccgcctccaccaagggc

SEQ ID NO: 19523 - RNA, 375 nt, synthetic construct
  misc_feature 1..375: note = derived and/or modified sequence opt2 from anti-HIV_Chain
  source 1..375: mol_type = other RNA
caggtccgcctctcccagtccggcggccagatgaagaagcccggcgagtccatgcgcctctcctgccgcgcctccggctacgagttcctcaactgccccatcaactggatccgcctcgcccccggccgccgccccgagtggatgggctggctcaagccccgcggcggcgccgtcaactacgcccgcaagttccagggccgcgtcaccatgacccgcgacgtctactccgacaccgccttcctcgagctccgctccctcacctccgacgacaccgccgtctacttctgcacccgcggcaagtactgcaccgcccgcgactactacaactgggacttcgagcactggggccgcggcgcccccgtcaccgtctcctcc

SEQ ID NO: 19524 - RNA, 375 nt, synthetic construct
  misc_feature 1..375: note = derived and/or modified sequence opt2 from anti-HIV_Chain
  source 1..375: mol_type = other RNA
gaggtccagctcgtccagtccggctccgacgtccgcaagcccggcgccaccgtcaccgtctcctgcaaggccgacgaggacgaggacgacttcaccgcctacaactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctcc

SEQ ID NO: 19525 - RNA, 375 nt, synthetic construct
  misc_feature 1..375: note = derived and/or modified sequence opt2 from anti-HIV_Chain
  source 1..375: mol_type = other RNA
caggtccagctcgtccagtccggcggcggcctcgtccagcccggcgagtccctccgcctctcctgcaccgcctccggcttcaccttctcctcctacaacatgaactgggtccgccaggcccccggcaagggcctcgagtggatctcctacatctccgacaagtccaagaacaagtactacgccgactccgtccgcggccgcttcaccatctcccgcgacaacgcccagaactccctcttcctccagatgtcctccctccgcgacgaggacaccgccgtctactactgcacccgcgagggcccccagcgctccttctacttcgactactggggccagggcatccaggtcaccgtctcctccgcctccaccaagggc

SEQ ID NO: 19526 - RNA, 375 nt, synthetic construct
  misc_feature 1..375: note = derived and/or modified sequence opt2 from anti-HIV_Chain
  source 1..375: mol_type = other RNA
gaggtccagctcgtcgagtccggcgccgaggtcaagaagcccggctcctccgtcaaggtctcctgcaaggcctccggcggcaccttctcctcctactccatctcctgggtccgccaggcccccggccagggcctcgagtggatgggcggcatcatccccatcttcgccaccacccactacggccagaagttccagggccgcatcaagatcaccgccgacaagtccacctccaccgcctacatggagctctcccgcctccgctccgaggacaccgccgtctactactgcgcccgcgaccgcgagttctacttctacggcatggacgtctggggccagggcaccaccgtcaccgtctcctccgcctccaccaagggc

SEQ ID NO: 19527 - RNA, 375 nt, synthetic construct
  misc_feature 1..375: note = derived and/or modified sequence opt2 from anti-HIV_Chain
  source 1..375: mol_type = other RNA
cagctccagctccaggagtccggccccggcctcgtcaagccctgggagaccctcgtcctcacctgctccgtctccggcggctccatctcctccggcgactactactggggctggatccgccagtcccccggcaagggccccgagtggatcggcaacatcttctactcctccggcaacacctactacaacacctccctcaagtcccgcgtcaccatctccgtcgacgtctccaagaaccgcttctccctcaagctcacctccatgaccgccgccgacaccgccgtctactactgcggccgcctctccaacaagggctggttcgacccctggggccagggcaccctcgtctccgtctcctccgcctccaccaagggc

SEQ ID NO: 19528 - RNA, 375 nt, synthetic construct
  misc_feature 1..375: note = derived and/or modified sequence opt2 from anti-HIV_Chain
  source 1..375: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccgacaccgacttcaccctcaccatctcctccctcgagcccgaggacttcgccgtctactactgccagcagcgcggcatctggcccctccagatcaccttcggccagggcacccgcctcgagatcaagcgcaccgtcgccgccccctccgtcttcatcttccccccctccgacgag

SEQ ID NO: 19529 - RNA, 375 nt, synthetic construct
  misc_feature 1..375: note = derived and/or modified sequence opt2 from anti-HIV_Chain
  source 1..375: mol_type = other RNA
tccgagatcgtcctcacccagtcccccggcaccctctccctctcccccggcgagcgcgccaccctctcctgccgcgcctcccagtccgtctcctcctcctacctcgcctggtaccagcagaagcccgtccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggcaccctccacccccgcaccttcggccagggcaccaaggtcgagatcaagcgcaccgtcgccgccccctccgtcttcatcttccccccctccgac

SEQ ID NO: 19530 - RNA, 375 nt, synthetic construct
  misc_feature 1..375: note = derived and/or modified sequence opt2 from anti-HIV_Chain
  source 1..375: mol_type = other RNA
tcccaggccgtcgtcacccagcccccctccgtctccggcgcccccggccagcgcgtcaccatctcctgctccggcggcccctccaacgtcggcggcaacctcgtctactggtacaagcagttccccggcaccgcccccaagctcctcatccgccgcgacgaccagcgcccctccggcgtccccgaccgcttctccggctccaagtccggcaactccgcctccctcgccatctccggcctccgccccgacgacgaggccttctacttctgcgccacctacgactcccacggctccatccgcctcttcggcggcggcaccctcctcaccgtcctctcccagcccaaggccgccccctccgtcaccctcttccccccc

SEQ ID NO: 19531 - RNA, 375 nt, synthetic construct
  misc_feature 1..375: note = derived and/or modified sequence opt2 from anti-HIV_Chain
  source 1..375: mol_type = other RNA
gacatccagatgacccagtccccctccaccctcgccgcctccatcggcggcaccgtccgcgtctcctgccgcgcctcccagtccatcaccggcaactgggtcgcctggtaccagcagcgccccggcaaggccccccgcctcctcatctaccgcggcgccgccctcctcggcggcgtcccctcccgcttctccggctccgccgccggcaccgacttcaccctcaccatcggcaacctccaggccgaggacttcggcaccttctactgccagcagtacgacacctaccccggcaccttcggccagggcaccaaggtcgaggtcaagcgcaccgtcgccgccccctccgtcttcatcttccccccctccgacgagcag

SEQ ID NO: 19532 - RNA, 375 nt, synthetic construct
  misc_feature 1..375: note = derived and/or modified sequence opt2 from anti-HIV_Chain
  source 1..375: mol_type = other RNA
gagatcgtcatgacccagtcccccgacaccctctccgtctcccccggcgagcgcgccaccctctcctgccgcgcctcccagtccgtcaactccaacctcgcctggtaccagcagaagcccggccaggccccccgcctcctcatctacggcgcctccacccgcgccaccgccgtccccgcccgcttctccggctccggctccggcaccgagttcaccctcaccatctcctccctccagtccgaggactccgccgtctactactgccagcagtactaccagtggctctcctacaccttcggccagggcaccaagctcgagatcaagcgcaccgtcgccgccccctccgtcttcatcttccccccctccgacgagcag

SEQ ID NO: 19533 - RNA, 375 nt, synthetic construct
  misc_feature 1..375: note = derived and/or modified sequence opt2 from anti-HIV_Chain
  source 1..375: mol_type = other RNA
cgccaggtccagctcgtccagtccggcgccgccctcaagaagcccggcgcctccctccgcatctcctgccaggcctacggctacaagttcaccgaccacctcatctactggtggcgccaggcccccggccagggcctcgagtggatcggctggatcaagcccgagaccggccagccctcctactcctacaagttccagggccgcgtctccctcacccgcgacaccttccaggagatcctcttcatggacctccgcggcctccgctccgacgacaccgccatctacttctgcgcccgccgccactccgactactgcgacttcgacgtctggggctccggctcccagatcctcgtctcctccgcctccaccaagggc

SEQ ID NO: 19534 - RNA, 375 nt, synthetic construct
  misc_feature 1..375: note = derived and/or modified sequence opt2 from anti-HIV_Chain
  source 1..375: mol_type = other RNA
caggtccagctcgtccagtccggcgccgccctcaagaagcccggcgcctccgtccgcatctcctgccaggcctacggctacaagttcaccgactacctcatccactggtggcgccaggcccccggccagggcctcgagtggatcggctggatcaagcccgagaccggccagccctcctactcctacaagttccagggccgcgtcaccctcacccgcgacaccttcgaggagatcctcttcatggacctccgcggcctccgctccgacgacaccgccatctacttctgcgcccgccgccactccgactactgcgacttcgacgtctggggctccggctcccaggtcatcgtctcctccgcctccaccaagggcgcc

SEQ ID NO: 19535 - RNA, 375 nt, synthetic construct
  misc_feature 1..375: note = derived and/or modified sequence opt2 from anti-HIV_Chain
  source 1..375: mol_type = other RNA
gaggtccagctcgtcgagtccggcggcggcctcgtcaagcccggcggctccctccgcctctcctgcgccgcctccggcttctccttctccgagcactacatgtcctggatccgcctcgcccccggcaagggcctcgagtggctctcctacatctcctcctccacccgcaccacctactccgccgactccgtccgcggccgcttcaccatctcccgcgacaccgccaagcagctcctcttcctccacatgtcctccctccgcgccgaggacaccgccgtctactactgcgtccgcctctacggcggcatcaacggctggttcgaccagtggggccagggcaccctcgtctccgtctcctccgcctccaccaagggc

SEQ ID NO: 19536 - RNA, 375 nt, synthetic construct
  misc_feature 1..375: note = derived and/or modified sequence opt2 from anti-HIV_Chain
  source 1..375: mol_type = other RNA
caggtccagctcgtccagtccggccccggcctcgtcaagccctccgagaccctctccctcacctgctccgtctccaacggctccatctcctccggcggctactactggtcctggctccgccagttccccggcaagggcctcgagtggatcggctccatccactacaccggccgcaccttctacaacccctccctcatgggccgcaccgccctctccatggacacctccaacaaccagttctccctcaaggtctcctccgtcaccgccgccgacaccgccctctactactgcgcccgcgagctccagtggatgttcgtcgtcgacccctggggccagggcaccctcgtcaccgtctcctccgcctccaccaagggc

SEQ ID NO: 19537 - RNA, 375 nt, synthetic construct
  misc_feature 1..375: note = derived and/or modified sequence opt2 from anti-HIV_Chain
  source 1..375: mol_type = other RNA
caggtccagctccaggagtccggccccggcctcgtcaagccctccgagaccctctccctcacctgctccgtctccaacggctccatctcctccggcggctactactggtcctggctccgccagttccccggcaagggcctcgagtggatcggctccatccactacaccggccgcaccatgtacaacccctccctcatgggccgccccgccctctccatggacacctccaacaaccagttctccctcaagctccgctccgtcaccgccgccgacaccgccctctacttctgcgcccgcgacctccagtggatcttcgtcgtcgacccctggggccagggcaccctcgtcaccgtctcctccgcctccaccaagggc

SEQ ID NO: 19538 - RNA, 375 nt, synthetic construct
  misc_feature 1..375: note = derived and/or modified sequence opt2 from anti-HIV_Chain
  source 1..375: mol_type = other RNA
gaggtccagctcctcgagtccggcggcggcctcgtccagcccggcggctccctccgcctctcctgcgccgtctccggcttcaccttcggcggccacgccgtctcctgggtccgccaggcccccggcaagggcctcgagtggctctcccagatctccggcaccggctcccgcaccgactacgccgacgccgtcaagggccgcttcaccgtctcccgcgacaactccaagaagaccgtctacctccagatgaactccctccgcgtcgaggacaccgccctcttctactgcgccacccgctcccccggcggcggctacgccttcgacatctggggccagggcgccatggtcaccgtctcctccgcctccaccaagggc

SEQ ID NO: 19539 - RNA, 375 nt, synthetic construct
  misc_feature 1..375: note = derived and/or modified sequence opt2 from anti-HIV_Chain
  source 1..375: mol_type = other RNA
caggtccagctcgtccagtccggcgccgaggtcaagaagcccggctcctccgtcaaggtctcctgcaaggtctccttcttctccaactacggcatctcctgggtccgccagcgccccggccagggcctcgagtggatgggccgcatcatccccgccatcgacgacatgacctacgcccagaccttccgcggccgcgtcaccttctccgccgacaagttcaccaccaccgcctacatggagctcaccggcctcaccttcgaggacaccgccacctacttctgcgcccgcgacccccaggtcaaccgccgcggcaactgcttcgaccactggggccagggcaccctcgtcaccgtctcctccgcctccaccaagggc

SEQ ID NO: 19540 - RNA, 375 nt, synthetic construct
  misc_feature 1..375: note = derived and/or modified sequence opt2 from anti-HIV_Chain
  source 1..375: mol_type = other RNA
caggtccagctccaggagtccggccccggcctcgtcaagccctccgagaccctctccctcacctgcaccgtctccggcggctccatctcctactactactggtcctggatccgccagccccccggcaagggcctcgagtggatcggcgacatctactactccggcaccaccgactacaacccctccctcaagtcccgcgtcaccatctccgtcgacacctccaagaaccagttctccctcaagctctcctccgtcaccgccgccgacaccgccgtctactactgcgcccgccgccgcggccagcgcctcctcgcctacttcgactactggggccagggctccctcgtcaccgtctcctccgcctccaccaagggc

SEQ ID NO: 19541 - RNA, 375 nt, synthetic construct
  misc_feature 1..375: note = derived and/or modified sequence opt2 from anti-HIV_Chain
  source 1..375: mol_type = other RNA
caggtccagctccaggagtccggccccggccccgtcaagccctccgagaccctctccctcacctgcaccgtctccggcggctccatgatctcctactactggtcctggatccgccagccccccggcaagggcctcgagtggatcggctacatcttcaccaacggccgcaccacctactccccctccctccgctcccgcgtcaccatctccctcgacacctccaccaaccacttctccctccgcctcaagtccgtcaccgccgccgacaccgccatctactactgcgcccgcctcgacggcgaggccttccgctactacctcgacctctggggccagggcaacctcgtcaccgtctcctccgcctccaccaagggc

SEQ ID NO: 19542 - RNA, 375 nt, synthetic construct
  misc_feature 1..375: note = derived and/or modified sequence opt2 from anti-HIV_Chain
  source 1..375: mol_type = other RNA
caggtccagctcgtccagtccggcgccgaggtcaagaagcccggcgcctccgtcaaggtctcctgcaagccctcctccaacaccttcacctcccactacatccactgggtccgccaggcccccggccagggcctcgagtggatgggcatgatcaaccccggcggctccacccgctacgcccccaagttccagggccgcgtcaccctcacccgcgacacctccacccgcaccgtctacatggagctctcctccctccgctccgaggacaccgccgtctactactgcgcccgcccccagtacaacctcggccgcgaccccctcgacgtctggggcctcggcaccatggtcaccgtctcctccgcctccaccaagggc

SEQ ID NO: 19543 - RNA, 375 nt, synthetic construct
  misc_feature 1..375: note = derived and/or modified sequence opt2 from anti-HIV_Chain
  source 1..375: mol_type = other RNA
caggtccagctccagcagtggggcgccggcctcctcaagccctccgagaccctctccctcacctgcgccgtctacggcggctccttctccggctactactggtcctggatccgccagccccccggcaagggcctcgagtggatcggcgagatcaaccactccggctccaccaactacaacccctccctcaagtcccgcgtcaccatctccgtcgacacctccaagaaccagttctccctcaagctctcctccgtcaccgccgccgacaccgccgtctactactgcgcccgcctccccatcggctccggctggtacggccgcgactactggggccagggcaccctcgtcaccgtctcctccgcctccaccaagggc

SEQ ID NO: 19544 - RNA, 375 nt, synthetic construct
  misc_feature 1..375: note = derived and/or modified sequence opt2 from anti-HIV_Chain
  source 1..375: mol_type = other RNA
caggtccagctcgtccagtccggcgccgaggtcaagaagcccggcgcctccgtcaaggtctcctgcaaggcctccggcaacaccttcacctcctacggcatcacctgggtccgccaggcccccggccagggcctcgagtggatgggctggatctccgcctacaacggcaacaccaactacgcccagaagctccaggaccgcctcaccatgaccaccgacacctccacctccaccgcctacatggagctccgctccctccgctccgacgacaccgccgtctactactgcgccttctcccgccactacggctccggcaactacgactactggggccagggcaccctcgtcaccgtctcctccgcctccaccaagggc

SEQ ID NO: 19545 - RNA, 375 nt, synthetic construct
  misc_feature 1..375: note = derived and/or modified sequence opt2 from anti-HIV_Chain
  source 1..375: mol_type = other RNA
cagttccgcctcgtccagtccggccccgaggtcaagaaccccggctcctccgtcaccgtctcctgcaaggcctccggcggcaccttctccggcctcggcatcaactgggtccgccaggcccccggccagggcctcgagtggctcggcgacatcaagaccatgtacggcaccaccaactacgcccccaagttccagggccgcgtcaccatcaccgccgacgagtccacctccacctcctacatggagctctccggcctccgctccgaggacaccgccgtcttctactgcgtccgcgagctcttcggccaccaccccgccttcggcgtctggggccagggcacctccgtcatcgtctcctccgcctccaccaagggc

SEQ ID NO: 19546 - RNA, 375 nt, synthetic construct
  misc_feature 1..375: note = derived and/or modified sequence opt2 from anti-HIV_Chain
  source 1..375: mol_type = other RNA
cgcgtccagctcgtccagtccggcgccgaggtcaagaagcccggctcctccgtcaccgtctcctgcaaggcctccggcggctccttctcctcctacgccatctcctgggtccgccaggcccccggccagggcctcgagtgggtcggcggcgtcaaggtcatgttcggcaccgtccactactcccagaaggtccagggccgcgtcaccatcaccgccgacgactccaccggcacctcctacctcgagctctccggcctccgctccgccgacaccgccgtctactactgcgcccgcaacgccggcgcctacttctaccccttcgacatctggggccagggcaccctcatcatcgtctcctccgcctccaccaagggc

SEQ ID NO: 19547 - RNA, 375 nt, synthetic construct
  misc_feature 1..375: note = derived and/or modified sequence opt2 from anti-HIV_Chain
  source 1..375: mol_type = other RNA
caggtccagctccaggagtccggccccggcctcgtcaagccctccgagaccctctccctcacctgcaccgtctccggcggctccatctcctcccgctcctactactggggctggatccgccagccccccggcaagggcctcgagtgggtcggctccatctactacaccggctccacctactactccccctccctcaagtcccgcgtcaccatctccgtcgacacctcccagaaccagttctccctcaagctcaactccgtcaccgccgccgacaccgccgtctactactgcgcccgccagaagggctccggcacctccctcctctactggggccagggcaccctcgtcaccgtctcctccgcctccaccaagggc

SEQ ID NO: 19548 - RNA, 375 nt, synthetic construct
  misc_feature 1..375: note = derived and/or modified sequence opt2 from anti-HIV_Chain
  source 1..375: mol_type = other RNA
caggtccagctcgtccagtccggcaccgaggtcaagaagcccggctcctccgtcaaggtctcctgcaaggcctccggcggcaccttctccgactccgacatcgcctgggtccgccaggcccccggccagggcctcgagtggatgggcggcatcacccccatgttcgacatggccaagtccgcccagaagttccgcggccgcctcatcatcaccgccgacaagtccaccggcaccgcctacatggagctctcctccctccgctacgaggacgccgccgtctacttctgcgcccgctcctccggcaacttcgagttcgccttcgagatctggggccagggcaccaagatcatcgtctccctcgcctccaccaagggc

SEQ ID NO: 19549 - RNA, 375 nt, synthetic construct
  misc_feature 1..375: note = derived and/or modified sequence opt2 from anti-HIV_Chain
  source 1..375: mol_type = other RNA
gtcgtccagctcgtccagtccggcaccgaggtcaagaagcccggctcctccgtcaaggtctcctgcaaggcctccggcggcaccttctccggctccgacatctcctgggtccgccaggcccccggccagggcctcgagtggatgggcggcatcatccccatgttcgacatcgaggaccacgcccagaagttccgcggccgcctcaccatcaccgccgacaagtccaccggcgccgcctacatggagctctcctccctccgctccgaggacgccgccgtctactactgcgcccgctcctccggcaactacgacttcgccttcgacatctggggccagggcacccgcctcatcgtctcctccgcctccaccaagggc

SEQ ID NO: 19550 - RNA, 375 nt, synthetic construct
  misc_feature 1..375: note = derived and/or modified sequence opt2 from anti-HIV_Chain
  source 1..375: mol_type = other RNA
gtcgtccagctcgtcgagtccggcaccgaggtcaagaagcccggctcctccgtcaaggtctcctgcaaggcctccggcggcaccttctccggctccgacatctcctgggtccgccaggcccccggccagggcctcgagtggatgggcggcatcatccccatgttcgacatcgagaaccacgccgagaagttccgcggccgcctcaccatcaccgccgtcaagtccaccggcgccgcctacatggagctctcctccctccgctccgaggacgccgccgtctactactgcgcccgctcctccggcaactacgacttcgcctacgacatctggggccagggcacccgcgtcatcgtctcctccgcctccaccaagggc

SEQ ID NO: 19551 - RNA, 378 nt, synthetic construct
  misc_feature 1..378: note = derived and/or modified sequence opt2 from anti-HIV_Chain
  source 1..378: mol_type = other RNA
caggtccagctcgtccagtccggctccgccatgaagaagcccggcgcctccgtccgcgtctcctgctggacctccgaggacatcttcgacaccaccgagctcatccactgggtccgccaggcccccggccagggcctcgagtggatcggctgggtcaaggccgtctccggcgccgtcaactacggctccctcgacttccgccaccgcgtctccctcacccgcgaccgcgacctctccaccgcccacatggacatccgcggcctcacccaggacgacaccgccacctacttctgcgcccgccagaagttcgcccgcggcgaccagggctggttcttcgacctctggggccgcggcaccctcatcgtcgtctcctccgcc

SEQ ID NO: 19552 - RNA, 378 nt, synthetic construct
  misc_feature 1..378: note = derived and/or modified sequence opt2 from anti-HIV_Chain
  source 1..378: mol_type = other RNA
caggtccagctccaggagtccggccccggcctcgtcaagccctccgagaccctctccctcacctgcaccgtctccggcggctccatctccaaccactactggtcctggatccgccagccccccggcaagggcctcgagtggatcggctacatctaccactccggcaacatcaactacaagtcctccctcaagtcccgcgccaccatctccatcgacacctccaacaaccagttctccctcaagctctcctccgtcatcgccgccgacaccgccgtctactactgcgcccgcaacttcggccccggctcccccaactacggcatggacgtctggggccagggcaccaccgtcaccgtctcctccgcctccaccaagggc

SEQ ID NO: 19553 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcggcggcgtcgtccagcccggccgctccctccgcctctcctgcgccgcctccggcttcaccttctcccaccacggcatccactgggtccgccaggcccccggcgagggcctcgagtgggtcgccgtcatctccgaggacggcaccaacatccactacgaggactccgtccgcggccgcttcaccatctcccgcgacaactccaagaacaccgtcgacctccagatgaactccctccgcgccgaggacaccgccgtctactactgcgcctccctcatctccatgcgcgacggcgacgccttcgacctctggggccagggcacccgcgtcaccgtctcctccgcctccaccaagggc

SEQ ID NO: 19554 - RNA, 378 nt, synthetic construct
  misc_feature 1..378: note = derived and/or modified sequence opt2 from anti-HIV_Chain
  source 1..378: mol_type = other RNA
caggtccagctcgtcgagtccggcggcggcctcggccagcccggcggctccctccgcctctcctgcgccgcctccggcttcaccttccgcaactacgccatgtcctgggtccgccaggccgccggcaagggcctcgagtgggtctccggcgtctccggcggcggcgacaccacctactacggcgactccgtcaagggccgcttcaccatctcccgcgacaactccaagaacaccctctacctccagatgaacaacctccgcgccgaggacaccgccgtctactactgcgccaaggacaagggcgtctggggctcctccgacttcgactactggggccagggcaccctcgtcaccgtctcctccgcctccaccaagggc

SEQ ID NO: 19555 - RNA, 378 nt, synthetic construct
  misc_feature 1..378: note = derived and/or modified sequence opt2 from anti-HIV_Chain
  source 1..378: mol_type = other RNA
gaggtccagctcgtcgagtccggcggcggcgtcgtccagcccggccgctccctccgcctctcctgcgccgcctccggcttcaccttctcccaccacggcatccactgggtccgccaggcccccggcgagggcctcgagtgggtcgccgtcatctccgaggacggcaccaacatccactacgaggactccgtccgcggccgcttcaccatctcccgcgacaactccaagaacaccgtcgacctccagatgaactccctccgcgccgaggacaccgccgtctactactgcgcctccctcatctccatgcgcgacggcgacgccttcgacctctggggccagggcacccgcgtcaccgtctcctccgcctccaccaagggc

SEQ ID NO: 19556 - RNA, 378 nt, synthetic construct
  misc_feature 1..378: note = derived and/or modified sequence opt2 from anti-HIV_Chain
  source 1..378: mol_type = other RNA
cgcggccccgtcaccctcgccgtctccctcggcgagcgcgccaccatcacctgcaagtcctcccagtccgtcctcgtccactccaacaacaagaactacctctcctggtaccagcagaagcccggccagccccccaagctcctcatctactgggcctccacccgcgagtccggcgtccccgagcgcttctccggctccggctccggcaccgacttcaccctctccatctcctccctccaggccgaggacgtcgccgtctactactgccaccagtacttctccaccccccgcaccttcggccagggcaccaaggtcgagatcaagggcaccgtcgccgccccctccgtcttcatcttccccccctccgacgagcagctc

SEQ ID NO: 19557 - RNA, 378 nt, synthetic construct
  misc_feature 1..378: note = derived and/or modified sequence opt2 from anti-HIV_Chain
  source 1..378: mol_type = other RNA
tccgagatcgtcatgacccagtcccccgccaccctctccatgtcccccggcgagcgcgccaccctctcctgccgcgcctccctctccgtcaacaccaacctcgcctggtaccagcagaagcccggccaggccccccgcctcctcatctacggcgcctccacccgcgccaccggcatccccgcccgcttctccggctccggctccggcaccgagttcaccctcaccatctcctccctccagtccgaggacttcgccctctactactgccagcagtacaaccactggccccagaccttcggccagggcaccaaggtcgagatcaagcgcaccgtcgccgccccctccgtcttcatcttccccccctccgacgagcagaag

SEQ ID NO: 19558 - RNA, 378 nt, synthetic construct
  misc_feature 1..378: note = derived and/or modified sequence opt2 from anti-HIV_Chain
  source 1..378: mol_type = other RNA
tccgagatcgtcctcacccagtcccccgccaccctctccctctcccccggcgagcgcgccaccctctcctgccgcgcctcccagtccatcaacaactacctcgcctggtaccagcagaagcccggccaggccccccgcctcctcatctacgacgcctccaaccgcgccaccggcatccccgcccgcttctccggcggcggctccggcaccgacttcaccctcaccatctcctccctcgagcccgaggacttcgccgtctactactgccagcagcgcgccaactggcgcctcctcaccttcggcggcggcaccaaggtcgagatcaagcgcaccgtcgccgccccctccgtcttcatcttccccccctccgacgagcag

SEQ ID NO: 19559 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcggcgccgtcaagaagcccggcgcctccgtcaaggtctcctgcgagacctacggctacaccttcaccgaccacttcatgcactggtggcgccaggcccccggccagggcctcgagtggatgggctggatcaacccctactcctccgccgtctcctactccccccgctaccagggccgcgtcaccatgacccgcgacaccttcctcgagaccgtctacatggagctccgcggcctcaagttcgacgacaccgccatctactactgcgccacccccaagtccggccgcgactactggtccttcgacctctggggccagggcaccctcgtcaccgtctcctccgcctccaccaagggc

SEQ ID NO: 19560 - RNA, 378 nt, synthetic construct
  misc_feature 1..378: note = derived and/or modified sequence opt2 from anti-HIV_Chain
  source 1..378: mol_type = other RNA
tcccaggtccagctcgtcgagtccggccccggcctcgtcaagccctccgagaccctctccctcacctgctccgtctccaacggctccatctcctccggcggctactactggtcctggctccgccagttccccggcaagggcctcgagtggatcggctccatccactacaccggccgcaccatgtacaacccctccctcatgggccgccccgccctctccatggacacctccaacaaccagttctccctcaagctctcctccgtcaccgccgccgacaccgccctctacttctgcgcccgcgacctccagtggatcttcgtcgtcgacccctggggccagggcaccctcgtcaccgtctcctccgcctccaccaagggc

SEQ ID NO: 19561 - RNA, 378 nt, synthetic construct
  misc_feature 1..378: note = derived and/or modified sequence opt2 from anti-HIV_Chain
  source 1..378: mol_type = other RNA
tccgtcgtccagctcgtcgagtccggccccggcctcgtcaagccctccgagaccctctccctcacctgctccgtctccaacggctccatctcctccggcggctactactggtcctggctccgccagttccccggcaagggcctcgagtggatcggctccatccactacaccggccgcaccatgtacaacccctccctcatgggccgccccgccctctccatggacacctccaacaaccagttctccctcaagctccgctccgtcaccgccgccgacaccgccctctacttctgcgcccgcgacctccagtggatcttcgtcgtcgacccctggggccagggcaccctcgtcaccgtctcctccgcctccaccaagggc

SEQ ID NO: 19562 - RNA, 378 nt, synthetic construct
  misc_feature 1..378: note = derived and/or modified sequence opt2 from anti-HIV_Chain
  source 1..378: mol_type = other RNA
tccggcggccgcctcgtccagcccggcggctccctccgcctctcctgctccgcctccggcttcaccctctccaactccgccatgtcctgggtccgccaggcccccggcaagggcctcgagtgggtctcctccatcctctcctccggcgtcggcaccttctacgccgactccgtcaagggccgcttcaccgtctcccgcgacaactcccgcaacaccctctacctccagatgaagtccctccgcgccgaggacaccgccctctactactgcgccaaggtccagatccagcagctcaacttcggcgtcatcaccgacgccggcctcgacgtctggggcaagggcaccaccctcatcgtctcctccgcctccaccaagggc

SEQ ID NO: 19563 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcgccgccgtcaagaagcccggcgcctccgtcaaggtctcctgcgaggcctacggctacaagttcaccgaccacttcatgcactggtggcgccaggcccccggccagggcctcgagtggatgggctggatcaacccctacacctccgccgtcaactactcccccaagtaccagggccgcgtcaccatgacccgcgacaccttcctcgagaccgtctacatggagctccgcggcctccgcgtcgacgacaccgccatctactactgcgccacccccaagtccggccgcgactactggtccttcgacctctggggccagggcaccctcgtcaccgtctcctccgcctccaccaagggc

SEQ ID NO: 19564 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcgccgccgtcaagaagcccggcgcctccgtcaaggtctcctgcgagacctacggctacaagttcaccgaccacttcatgcactggtggcgccaggcccccggccagggcctcgagtggatgggctggatcaacccctactcctccgccgtctcctactccccccgctaccagggccgcgtcaccatgacccgcgacaccttcctcgagaccgtctacatggagctccgcggcctccgcttcgacgacaccgccatctactactgcgccacccccaagtccggccgcgactactggtccttcgacctctggggccagggcaccctcgtcaccgtctcctccgcctccaccaagggc

SEQ ID NO: 19565 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcgccgccgtcaagaagcccggcgcctccgtcaaggtctcctgcgagacctacggctacaccttcaccgaccacttcatgcactggtggcgccaggcccccggccagggcctcgagtggatgggctggatcaacccctactcctccgccgtctcctactccccccgctaccagggccgcgtcaccatgacccgcgacaccttcctcgagaccgtctacatggagctccgcggcctcaagttcgacgacaccgccatctactactgcgccacccccaagtccggccgcgactactggtccttcgacctctggggccagggcaccctcgtcaccgtctcctccgcctccaccaagggc

SEQ ID NO: 19566 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcgccgaggtcaagaagcccggctcctccgtcaaggtctcctgcaagacctccggcgtccgcttctcctccaacgccatctcctgggtccgccaggcccccggccagggcctcgagtggatgggccgcaccacccccatgctcggcggcgccaaccacgccccctccttcaagggccgcgtcaccatctccgccgacgagtccacccgcaccgtctacatggagatgtcctccctccgctacgaggacaccgccgtctactactgcgcctccggccgccgcgagggcctcaacttcctcctcgactactggggccagggcaccctcgtcaccgtctcctccgcctccaccaagggc

SEQ ID NO: 19567 - RNA, 378 nt, synthetic construct
  misc_feature 1..378: note = derived and/or modified sequence opt2 from anti-HIV_Chain
  source 1..378: mol_type = other RNA
caggtccagctccaggagtccggccccggcctcgtcaagccctccgagaccctctccctcacctgcaccgtctccggcggctccatctccacctactactggtcctggatccgccagccccccggcaagggcctcgagtggatcggctacatctcctactccggctccaccaactacaacccctccctcaagtcccgcgtcaccatctccgtcgacacctccaagaaccagttctccctcaagctctcctccgtcaccgccgccgacaccgccgtctactactgcgcccgccacaagtccgtcctcctctggttccgcgagctcgactactggggccagggcaccctcgtcaccgtctcctccgcctccaccaagggc

SEQ ID NO: 19568 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcgccgaggtcaagaagcccggcgccgccgtcaagatctcctgcaaggcctcccgcttcaccttctcctcctactacatccactgggtccgccaggcccccggccagggcctcgagtggatgggcatcatcaacccctccggcggctccacctccaacgcccagaagttccaggaccgcgtcaccctcacccgcgacatgtccaccggcaccgtctacatggagctctcccgcctcacctccgaggacaccgccgtctactactgcgccacccccgagccctcctccatcgtcgcccccctctactactggggccagggcaccctcgtcaccgtctcctccgcctccaccaagggc

SEQ ID NO: 19569 - RNA, 378 nt, synthetic construct
  misc_feature 1..378: note = derived and/or modified sequence opt2 from anti-HIV_Chain
  source 1..378: mol_type = other RNA
caggtccagctcgtccagtccggcgccgagatgaagaagcccggcgcctccgtcaaggtctcctgcaaggcctccggccacaccttcaccaactactacatgcactgggtccgccaggcccccggccagggcctcgagtggatgggcatgatcaaccccaccggcgactccacccgctacgcccagcgcttccagggccgcgtcaccatgacccgcgacacctccacccgcaccgtctacatggagctctcctccctccgctccgacgacaccgccgtctactactgcgcccgcgcccaccacgacttctggcgcgcccccgtcgacgtctggggcaagggcaccaccgtcaccgtctcctccgcctccaccaagggc

SEQ ID NO: 19570 - RNA, 378 nt, synthetic construct
  misc_feature 1..378: note = derived and/or modified sequence opt2 from anti-HIV_Chain
  source 1..378: mol_type = other RNA
caggtcgtcctcatccagtccggcgccgaggtcaagcgccccggctcctccgtcaaggtctcctgcaaggcctccggcggctccttccccatcacctgggtccgccaggcccccggccacggcctcgagtggatgggcggcatcaaccccttcttcggcaccaccaactacgcccagaagttccagggccgcgtctccatcaccgccgacgagtccacctccaccacctacctccacctctccgacctccgctccgaggacaccgccgtctacttctgcgcccgcgagaaccgcgagaagtggctcgtcctccgctcctggttcgccccctggggccagggcaccctcgtcaccgtctcctccgcctccaccaagggc

SEQ ID NO: 19571 - RNA, 378 nt, synthetic construct
  misc_feature 1..378: note = derived and/or modified sequence opt2 from anti-HIV_Chain
  source 1..378: mol_type = other RNA
tcccagcagctcgtccagtccggcgcccaggtcaagaagcccggcgcctccgtccgcgtctcctgccaggcctccggctacaccttcaccaaccacttcctccactggtggcgccaggccccccgccagggcctcgagtggatgggctggatcaaccccgtccacggcggccgcaactacgcccgccgcttccagggccgcatcaacttcggccgcgacgtctaccaggagaccgcctacatggagctctccggcctccgcaacgacgacaccgccacctacttctgcgcccgcggcggcggcgacggccgcaactggcacctccacccctggggccagggcaccctcgtcatcgtctccgccgcctccaccaagggc

SEQ ID NO: 19572 - RNA, 378 nt, synthetic construct
  misc_feature 1..378: note = derived and/or modified sequence opt2 from anti-HIV_Chain
  source 1..378: mol_type = other RNA
gaggtccaggtcgtcgagtccggcggcggcctcgtccagcccggcggctccctccgcctctcctgcgtcgcctccggcttcaccttctccgagtactggatgtcctgggtccgccaggcccccggcaagggcctcgagtgggtcgccaccatcaagcgcgacggctccgaggagtcctacgtcgactccgtcaagggccgcttcaccatctcccgcgacaacgccaagaactccctctacctccagatgaactccctccgcgccgaggacaccgccgtctactactgcgcccgcgtccgcgaccccaactacaacctccacttcgactcctggggccagggcaccctcgtcaccgtctcctccgcctccaccaagggc

SEQ ID NO: 19573 - RNA, 378 nt, synthetic construct
  misc_feature 1..378: note = derived and/or modified sequence opt2 from anti-HIV_Chain
  source 1..378: mol_type = other RNA
ctcgtccagctcgtcgagtccggcggcggcgtcgtccagcccggcaagtccctccgcctctcctgcgccacctccggcttcaccttctccacctacggcatgcactgggtccgccaggcccccggcaagggcctcgagtgggtcgccgtcatctggtacgacggctcctacaagtactacgccgactccgtcaagggccgcttcaccatctcccgcgacaactccaagaacaccctcttcctccagatgaactccctccgcgccgaggacaccgccatgtactactgcggccgcgagatggccgtcggcggcaccaaggccctcgaccactggggccagggcaccctcgtcaccgtctcctccgcctccaccaagggc

SEQ ID NO: 19574 - RNA, 378 nt, synthetic construct
  misc_feature 1..378: note = derived and/or modified sequence opt2 from anti-HIV_Chain
  source 1..378: mol_type = other RNA
gagttccagctcgtccagtccggcggcggcctcgtcaagcccggcggctccctccgcctctcctgcaccggctccaccttctccttctcctccgacgacatgaactgggtccgccaggcccccggcaagggcctcgagtgggtctcctccatgtccgactccggctcccacatctactacgccgacttcgtcaagggccgcttcaccatctcccgcgacaacgccaagaagtccctctacctccagatgaactccctccgcgccgaggacaccgccgtctactactgcgcccagtcccgccccccccagcgcctctacggcatggacgtctggggccagggcaccaccgtcaccgtctcctccgcctccaccaagggc

SEQ ID NO: 19575 - RNA, 381 nt, synthetic construct
  misc_feature 1..381: note = derived and/or modified sequence opt2 from anti-HIV_Chain
  source 1..381: mol_type = other RNA
gaggtccagctcgtcgagtccggcggcggcgtcgtccagcccggcggctccctccgcctctcctgcgccgcctccggcttcatgttcaagaactacgccatgcactgggtccgccagccccccggcaagggcctcgagtgggtcgccgtcatctggtacggcggccgcgaccagaactacgccgactccgtcaagggccgcttcaccatctcccgcgacgactccgacaacaccctctacctccagatgaactccctccgcgccggcgacaccgccgtctacttctgcgcccgcaactcccaggtcggccgcctcatgcccgccgccggcgtctggggccagggcaccctcgtcaccgtctcctccgcctccaccaagggc

SEQ ID NO: 19576 - RNA, 381 nt, synthetic construct
  misc_feature 1..381: note = derived and/or modified sequence opt2 from anti-HIV_Chain
  source 1..381: mol_type = other RNA
cagggccacctcgtccagtccggcggcggcgtcaagaagctcggcacctccgtcaccatctcctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccacc

SEQ ID NO: 19577 - RNA, 381 nt, synthetic construct
  misc_feature 1..381: note = derived and/or modified sequence opt2 from anti-HIV_Chain
  source 1..381: mol_type = other RNA
caggtccagctcctcgagtccggcggcggcctcgtccagcgcggcggctccctccgcctctcctgcaccgcctccggcttcgtcttcaacaactactggatgacctgggtccgccaggcccccggcaacggcctcgagtgggtcgccaacatcgaccaggacggctccgagaagcactacctcgactccgtcaagggccgcttcaccatctcccgcgacaacgccaagaactccctctacctccagatgaactccctccgcgccgaggacaccgccatctactactgcgcccgcgtccgcttcaaggtcaccgcctggcaccgcttcgactcctggggccagggcgacctcgtcaccgtctcctccacctccaccaagggc

SEQ ID NO: 19578 - RNA, 381 nt, synthetic construct
  misc_feature 1..381: note = derived and/or modified sequence opt2 from anti-HIV_Chain
  source 1..381: mol_type = other RNA
cagtccgccctcacccagcccccctccgcctccggcacccccggccagcgcgtcaccatctcctgctccggctcctaccacaacatcggctccaacgccgtcaactggtaccagcagctccccggcaccgcccccaagctcctcatctactccaacgaccagcgcccctccggcgtccccgaccgcttctccggctccaagtccggcacctccgcctccctcgccatctccggcctccagtccgaggacgaggccgactactactgcgccgcctgggacgactccctccacgtcttcggcaccggcaccaaggtcaccgtcctcggccagcccaaggccaaccccaccgtcaccctcttccccccctcctccgaggagctc

SEQ ID NO: 19579 - RNA, 381 nt, synthetic construct
  misc_feature 1..381: note = derived and/or modified sequence opt2 from anti-HIV_Chain
  source 1..381: mol_type = other RNA
cagtccgtcctcacccaggtcctctccgtctccggcacccccggccagcgcgtcatcatctcctgctccggcacctcctccaacgtcggcggcaacctcgtctcctggtaccagcacctccccggcgccgccccccgcctcctcatccaccgcgacgaccagcgcccctccggcgtccccgaccgcttctccggctccaagtccggcaactccgcctccctcgtcatctccggcctccgctccgacgacgaggccgactacttctgcgccgcctacgactccaccttctccctccccgtcttcggcggcggcacccgcctcaccgtcctctcccagcccaaggccgccccctccgtcaccctcttccccccctcctccgag

SEQ ID NO: 19580 - RNA, 381 nt, synthetic construct
  misc_feature 1..381: note = derived and/or modified sequence opt2 from anti-HIV_Chain
  source 1..381: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccctgccagttccagggccgcgtctccctcacccgccacgcctcctgggacttcgacaccttctccttctacatggacctcaaggccctccgctccgacgacaccgccgtctacttctgcgcccgccagcgctccgactactgggacttcgacgtctggggctccggcacccaggtcaccgtctcctccgcctccaccaag

SEQ ID NO: 19581 - RNA, 381 nt, synthetic construct
  misc_feature 1..381: note = derived and/or modified sequence opt2 from anti-HIV_Chain
  source 1..381: mol_type = other RNA
caggtccagctcgtccagtccggcggcgaggtccgcaagcccggctcctccgtcaaggtcccctgcaagatctccggcaacgccttctccaactacggcgtcaactgggtccgccaggcccccggccagggcctcgagtgggtcggccgcatcatccccgtcatcggcgtcgcccagcacgcccccaagttccagggccgcgtcaccatcaccgccgacaagtccaccaccaccgcctacctcgagctctcctccctccgctccgacgacaccgccgtctacttctgcgccaaggaccacggcgacccccgcaccggctactacttcgactactggggccagggcgccctcgtcaccgtctcctccgcctccaccaagggc

SEQ ID NO: 19582 - RNA, 381 nt, synthetic construct
  misc_feature 1..381: note = derived and/or modified sequence opt2 from anti-HIV_Chain
  source 1..381: mol_type = other RNA
caggtccagctcggccagtccggcaccgaggtcaagaagcccggcttctccgtcaaggtctcctgcaaggcctccggcggctcctccaccgcctacggctactcctgggtccgccaggcccccggccagggcttcgagtggatgggccgcatcatccccttctacggcatcatcacctacgcccccaagttccagggccgcgtcaccatcaccgccgaccgctccacctccaccgtctacatggagctcacctccctcaccttcgccgacaccgccctcttcttctgcgcccgcgacttcggcgacccccgcaacggctactacttcgactcctgggaccagggcctctggctcaccgtctcctccgcctccaccaagggc

SEQ ID NO: 19583 - RNA, 381 nt, synthetic construct
  misc_feature 1..381: note = derived and/or modified sequence opt2 from anti-HIV_Chain
  source 1..381: mol_type = other RNA
caggtccagctcgtccagtccggcgccgaggtcaagaagcccggctcctccgtcaaggtctcctgcaaggcctccggcggcaccttctccaactacgccatctcctgggtccgccaggcccccggccagggcctcgagtggatgggcggcatcatccccatcttcgaggccgcctcctacgcccagaagttccaggaccgcctcaccatcaccaccgacgagtccaccaccaccgcctacatggacctctcctccctccgctccgaggacaccgccatctactactgcgcccgcgcccagggcgacatcctcaccgagggctacttcgactactggggccagggcaccctcgtcaccgtctcctccgcctccaccaagggc

SEQ ID NO: 19584 - RNA, 381 nt, synthetic construct
  misc_feature 1..381: note = derived and/or modified sequence opt2 from anti-HIV_Chain
  source 1..381: mol_type = other RNA
caggtccagctccaggagtccggccccggcctcgtcaagccctccgagaccctctccctcacctgcaccgtctccggcggctccatctcctccgccggctactactggtcctggatccgccagcaccccgagaagggcctcgagttcatcggctacatctactacctcggcaccacctactacaacccctccctcaagtcccgcgtctccatctccatcgacacctccaacaaccagttctccctcgagctctcctccgtctccgccgccgacaccgccatctactactgcgcccgcgactacaccgcctccggccgccacttcttcgactactggggccagggcaccctcgtcaccgtctcctccgcctccaccaagggc

SEQ ID NO: 19585 - RNA, 381 nt, synthetic construct
  misc_feature 1..381: note = derived and/or modified sequence opt2 from anti-HIV_Chain
  source 1..381: mol_type = other RNA
caggtccagctcgtccagtccggcgccgaggtcaagaagcccggcgcctccgtcaaggtctcctgcaaggcccccggctacaccttcatcggccactacatgcactggatccgccaggcccccggccagggcctcgagtggatgggctggatcaaccccaactccggcgacaccaactacgcccagaccttccagggccgcgtcaccatgacccgcgacacctccatctccaccgcctacatggagctcacccgcctccgctccgacgacaccgccgtctactactgcgcccgcgacctccgccccatgcgcggcaactgggccatgcacgtctggggcgagggcaccaccgtcaccgtctcctccgcctccaccaagggc

SEQ ID NO: 19586 - RNA, 381 nt, synthetic construct
  misc_feature 1..381: note = derived and/or modified sequence opt2 from anti-HIV_Chain
  source 1..381: mol_type = other RNA
caggtccagctccaggagtccggccccggcctcgtcaagccctccgagaccctctccctcacctgcaccgtcttcggcgcctccatccgctccttctactggcactggatccgccagtcccccggcaagggcctcgagtggctcggctccgtcttcgacaacggcctcaccacctacaacccctccctcaagaaccgcctctccatctccgaggacccctcccgcaaccagatctccctcaacctccgctccatgaccgccgccgacaccgccgtctactactgcgcccgcgccgactacgacctcctcacctcctcctaccacttcgactcctggggccagggcaccctcgtcaccgtctcctccgcctccaccaagggc

SEQ ID NO: 19587 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcgtctcctgccaggcctccggctacaccttcaccgactacgtcctccactggtggcgccaggcccccggccagggcctcgagtggatgggctggatcaagcccgtctacggcgcccgcaactacgcccaccgcttccagggccgcatcaacttcgaccgcgacgtctaccgcgagatcgcctacatggacctctccggcctccgctccgacgacaccgccgtctacttctgcgcccgcgacggctccggcgacgccacctcctggcacctccacccctggggccagggcaccctcgtcatcgtctcctccgcctccaccaagggc

SEQ ID NO: 19588 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcgtctcctgccaggcctccggctacaccttcaccaactacatcctccactggtggcgccaggcccccggccgcggcctcgagtggatgggcctcatcaagcccgtctacggcgccgtcaactacgcccgccagttccagggccgcatccagctcacccgcgacatctaccgcgagatcgccttcctcgacctctccggcctccgccccgacgacaccgccgtctactactgcgcccgcgacgagtccggctacgacctcaactggcacctcgactcctggggccagggcacccaggtcatcgtctcccccgcctccaccaagggc

SEQ ID NO: 19589 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcgcccaggtcaagaagcccggcgcctccctccgcgtctcctgccaggcctccggctacaccttcatgaactacctcctccactggtggcgccaggcccccggccagggcctcgagtggatgggctggatcaaccccgtctacggcgccgtcaactacgcccaccgcttccagggccgcctcaccttctcccgcgacgtctaccgcgagatcgcctacatggacctcaacggcctccgctccgacgacaccgccgtctacttctgcgcccgcgacggctccggcgacgaccgcaactggcacctcgacccctggggccagggcaccctcgtcatcgtctcctccgcctccaccaagggc

SEQ ID NO: 19590 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcatctcctgccaggcctccggctacaccttcaccgactacgtcctccactggtggcgccaggcccccggccagggcctcgagtggatgggctggatcaagcccgtctacggcgcccgcaactacgcccgccgcttccagggccgcatcaacttcgaccgcgacatctaccgcgagatcgccttcctcgacctctccggcctccgctccgacgacaccgcccgctacttctgcgcccgcgacggctccggcgacgacacctcctggcacctccacccctggggccagggcaccctcgtcatcgtctccgccgcctccaccaagggc

SEQ ID NO: 19591 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagaccggcgcctccgtccgcgtctcctgccaggcctccggctacgacttcaccaagtacctcatccactggtggcgccaggcccccggccagggcctcgagtggatgggctggatgaagcccgtctacggcgccaccaactacgcccaccgcttccagggccgcatctccttcacccgcgacatctaccgcgagatcgccttcatggacctcaacggcctccgctccgacgacaccgccgtctacttctgcgcccgcgacggcggcggcgacgaccgcacctggctcctcgacgcctggggccagggcaccctcgtcatcgtctcctccgcctccaccaagggc

SEQ ID NO: 19592 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcgtctcctgccaggcctccggctacaccttcatgaactacatcatccactggtggcgccaggcccccggccagcgcctcgagtggatgggctggatcaaccccgtcttcggcgcccgcaactacgcccaccgcttccagggccgcatcaacttcgaccgcgacatcaaccgcgagaccttccagatggacctcaccggcctccgctccgacgacaccgccgtctactactgcgcccgcgacggctccggcgacgcccgcgactggcacctccacccctggggccagggcaccctcgtcatcgtctcctccgcctccaccaagggc

SEQ ID NO: 19593 - RNA, 381 nt, synthetic construct
  misc_feature 1..381: note = derived and/or modified sequence opt2 from anti-HIV_Chain
  source 1..381: mol_type = other RNA
tcccagcacctcgtccagtccggcacccaggtcaagaagcccggcgcctccgtccgcgtctcctgccaggcctccggctacaccttcaccaactacatcctccactggtggcgccaggcccccggccagggcctcgagtggatgggcctcatcaagcccgtcttcggcgccgtcaactacgcccgccagttccagggccgcatccagctcacccgcgacatcaaccgcgagatcgccttcctcgacctctccggcctccgctccgacgacaccgccgtctactactgcgcccgcgacgagtccggcgacgacctcaagtggcacctccacccctggggccagggcacccaggtcatcgtctcccccgcctccaccaagggc

SEQ ID NO: 19594 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcgtctcctgccaggcctccggctacaccttcatgaactacatcatccactggtggcgccaggcccccggccagcgcctcgagtggatgggctggatcaaccccgtcttcggcgcccgcaactacgcccaccgcttccagggccgcatcaacttcgaccgcgacatcaaccgcgagaccttccagatggagctcaccggcctccgctccgacgacaccgccgtctactactgcgcccgcgacggctccggcgacgcccgcgactggcacctcgacccctggggccagggcaccctcgtcatcgtctcctccgcctccaccaagggc

SEQ ID NO: 19595 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcatctcctgccaggcctccggctacaccttcaccgactacgtcctccactggtggcgccaggcccccggccagggcctcgagtggatgggctggatcaagcccgtctacggcgcccgcaactacgcccgccgcttccagggccgcatcaacttcgaccgcgacatctaccgcgagatcgcctacatggacctctccggcctccgctccgacgacaccgcccgctacttctgcgcccgcgacggctccggcgacgacacctcctggcacctccacccctggggccagggcaccctcgtcatcgtctccgccgcctccaccaagggc

SEQ ID NO: 19596 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcatctcctgccaggcctccggctactccttcaccgactacgtcctccactggtaccgccaggcccccggccagggcctcgagtggatgggctggatcaagcccgtctacggcgcccgcaactacgcccgccgcttccagggccgcatcaacttcgaccgcgacatctaccgcgagatcgccttcatggacctctccggcctccgctccgacgacaccgccctctacttctgcgcccgcgacggctccggcgacgacacctcctggtacctcgacccctggggccagggcaccctcgtcatcgtctccgccgcctccaccaagggc

SEQ ID NO: 19597 - RNA, 381 nt, synthetic construct
  misc_feature 1..381: note = derived and/or modified sequence opt2 from anti-HIV_Chain
  source 1..381: mol_type = other RNA
tcccagcagctcgtccagtccggcacccaggtcaagaagcccggcgcctccgtccgcatctcctgccaggcctccggctactccttcaccgactacgtcctccactggtggcgccaggcccccggccagggcctcgagtggatgggctggatcaagcccgtctacggcgcccgcaactacgcccgccgcttccagggccgcatcaacttcgaccgcgacatctaccgcgagatcgccttcatggacctctccggcctccgctccgacgacaccgccctctacttctgcgcccgcgacggctccggcgacgacacctcctggcacctcgacccctggggccagggcaccctcgtcatcgtctccgccgcctccaccaagggc

SEQ ID NO: 19598 - RNA, 381 nt, synthetic construct
  misc_feature 1..381: note = derived and/or modified sequence opt2 from anti-HIV_Chain
  source 1..381: mol_type = other RNA
tcccagcacctcgtccagtccggcacccaggtcaagaagcccggcgcctccgtccgcgtctcctgccaggcctccggctacaccttcaccaactacatcctccactggtggcgccaggcccccggccagggcctcgagtggatgggcctcatcaagcccgtcttcggcgccgtcaactacgcccgccagttccagggccgcatccagctcacccgcgacatctaccgcgagatcgccttcctcgacctctccggcctccgctccgacgacaccgccgtctactactgcgcccgcgacgagtccggcgacgacctcaagtggcacctccacccctggggccagggcacccaggtcatcgtctcccccgcctccaccaagggc

SEQ ID NO: 19599 - RNA, 381 nt, synthetic construct
  misc_feature 1..381: note = derived and/or modified sequence opt2 from anti-HIV_Chain
  source 1..381: mol_type = other RNA
caggtccagctcgtcgagtccggcggcggcgtcgtccagcccggcaagtccctccgcctctcctgcgccatctccggcttcctcttcaacaactacggcggccagtgggtccgccaggcccccggcaagggcctcgagtgggtcgccgccatctcctacgacggcaacaaccgctactacgccgactccgccaagggccgcttcctcatctcccgcgacacccccaagaacatcctctacctccagatctactccctccgcctcgacgacaccgccgtctactactgcgcccgcgactccgtctccaagtcctactccgccccccccgagttctggggccagggcaccgtcgtcaccgtctcctccgcctccaccaagggc

SEQ ID NO: 19600 - RNA, 381 nt, synthetic construct
  misc_feature 1..381: note = derived and/or modified sequence opt2 from anti-HIV_Chain
  source 1..381: mol_type = other RNA
caggtccacctcgaggagtccggccccggcctcgtcaagacctcccagaccctctccctcacctgctccgtctcctcctactccatctcccgctccggctacttctggacctggatccgccagcgccccggcaagggcctcgagtggatcggctacatctacttcaacggccgcaccacctacaacccctccctcaagtcccgcatcaccatctcccgcgacacctcccactcccagttctccctcaccctcaactccctctccgccgccgacaccgccgtctactactgcggccgctgccaggacggcctcgcctcccgccccatcgacttctggggccagggcaccctcgtcaccgtctcctccgcctccaccaagggc

SEQ ID NO: 19601 - RNA, 381 nt, synthetic construct
  misc_feature 1..381: note = derived and/or modified sequence opt2 from anti-HIV_Chain
  source 1..381: mol_type = other RNA
caggtccagctcgtcgagtccggcggcggcgtcgtccagcccggccgctccctccgcctctcctgcgccacctccggcttcacctccaagaactacggcgtccactgggtccgccaggcccccggcaagggcctcgagtgggtcgccgtcatctggtacgacggctccaacaagttctacgccgactccgtcaagggccgcttcaccatctcccgcgaccgctccaagaacatggtctacctccagatgaactccctccgcgtcgaggacaccgccatctactactgcgcccgcgactccgtcgccttcgtcctcgagggccccatcgactactggggccagggcaccctcgtcaccgtctcctccgcctccaccaagggc

SEQ ID NO: 19602 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcggcggcgtcaagaagcccggcacctccgcctccttctcctgccgcacctccgacgacatctacgacaacgagttcttcgactccgccttcatgcactgggtccgcctcatccccggccagcgccccgagtggatgggctggatgaacccccgctccggcgccgtcaactacgcccgccagctccagccccgcgtctccatgtaccgcgaccgcgacctctccaccgcctacatggagttcaagtccctcacctccgccgacaccggcacctacttctgcgcccgcaagaagcgcggcgacggcttcaacctctacttcgacctctggggccgcggctcccaggtcatcgtctcctccgcc

SEQ ID NO: 19603 - RNA, 384 nt, synthetic construct
  misc_feature 1..384: note = derived and/or modified sequence opt2 from anti-HIV_Chain
  source 1..384: mol_type = other RNA
cagggccacctcgtccagtccggcggcggcgtcaagaagctcggcacctccgtcaccatctcctgcctcgcctccgaggacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccacctcc

SEQ ID NO: 19604 - RNA, 384 nt, synthetic construct
  misc_feature 1..384: note = derived and/or modified sequence opt2 from anti-HIV_Chain
  source 1..384: mol_type = other RNA
cagtccgccctcacccagcccccctccgtctccggcgcccccggccagcgcgtcaccatctcctgctccggcggcccctccaacgtcggcggcaactacgtctactggtaccgccagttccccggcaccgcccccaagctcctcatcctccgcgacgaccagcgcccctccggcgtccccgaccgcttctccgcctccaagtccggcaactccgcctccctcgccatctccggcctccgccccgacgacgaggccttctacttctgcgccacctacgactcccagggctccttccgcgtcttcggcggcggcaccgccctcaccgtcctctcccagcccaaggccgccccctccgtcaccctctaccccccctcctccgaggag

SEQ ID NO: 19605 - RNA, 384 nt, synthetic construct
  misc_feature 1..384: note = derived and/or modified sequence opt2 from anti-HIV_Chain
  source 1..384: mol_type = other RNA
aacttcatgctcacccagcccccctccgcctccggcacccccggccagcgcgtcaccatctcctgctccggcggcggctccaacatcggcggcaacctcgtctcctggtaccagcacttccccggcgccgcccccaagctcctcatctaccgcaacgaccagcgcccctccggcgtccccgaccgcttctccggctccaagtccggcacctccgcctccctcgccatctccggcctccgctccgacgacaaggccacctacttctgcgccgcctacgactccaccctctccctccgcctcttcggcggcggcaccaccctcaccgtcctctcccagcccaaggccgccccctccgtcaccctcttccccccctcctccgaggag

SEQ ID NO: 19606 - RNA, 384 nt, synthetic construct
  misc_feature 1..384: note = derived and/or modified sequence opt2 from anti-HIV_Chain
  source 1..384: mol_type = other RNA
aacttcatgctcacccagcccccctccgtctccgccacccccggccagaccgtcaccatctcctgctccggctccggctccaacgtcggcggcaaccacgtctactggtaccgccagctccccggcgccgcccccaccctcgtcatctccaagaccgaccaccgcccctcccgcgtccccgaccgcttctccggctccaagtccggcaactccgcctccctcgccatctccggcctccgccccgacgacgaggccgtctacttctgcgccacctacgacaccggcctctccctccgcctcttcggcggcggcacccgcctcaccgtcctctcccagcccaaggccgccccctccgtcacccagttccccccctcctccgaggag

SEQ ID NO: 19607 - RNA, 384 nt, synthetic construct
  misc_feature 1..384: note = derived and/or modified sequence opt2 from anti-HIV_Chain
  source 1..384: mol_type = other RNA
cagtccgccctcacccagcccccctccgcctccggcgcccccggccagcgcgtcaccatctcctgctccggcggcccctccaacgtcggcggcaactacgtctactggtaccgccagttccccggcaccgcccccaagctcctcatcctccgcgacgaccagcgcccctccggcgtccccgaccgcttctccgcctccaagtccggcaactccgcctccctcgccatctccggcctccgccccgacgacgaggccctctacttctgcgccacctacgactccgacggctccatccgcctcttcggcggcggcaccgccctcaccgtcctctcccagcccaaggccgccccctccgtcaccctcttcccccccggctgggaggag

SEQ ID NO: 19608 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgcctcttccagggccgcgtctccctcacccgccacgcctcctgggacttcgacaccttctccttctacatggacctcaaggccgtccgctccgacgacaccgccgtctacttctgcgcccgccagcgctccgactactgggacttcgacgtctggggctccggcacccaggtcaccgtctcctccgcctccaccaagggc

SEQ ID NO: 19609 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgtcgtcaccaagcccggcgcctccgtccgcgtctcctgcgaggcctccggctacaagatccgcgactacttcatccactggtggcgccaggcccccggccagggcctccagtgggtcggctggatcaacccccagaccggccagcccaacatcccccgccccttccagggccgcgtcaccctcacccgccacgcctcctgggacttcgacaccttctccttctacatggacctcaaggccctccgctccgacgacaccgccatctacttctgcgcccgccgccgctccgactactgcgacttcgacgtctggggctccggcacccacgtcaccgtctcctccgcctccaccaagggc

SEQ ID NO: 19610 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccaggcctcctgggacttcgacaccatctccttctacatggacctcaaggccctccgcctcgacgacaccgccgtctacttctgcgcccgccagcgctccgactactgggacttcgacgtctggggctccggcacccaggtcaccgtctcctccgcctccaccaagggc

SEQ ID NO: 19611 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccacgcctcctgggacttcgacaccttctccttctacatggacctcaaggccctccgctccgacgacaccgccgtctacttctgcgcccgccagcgctccgactactgggacttcgacgtctggggctccggcacccaggtcaccgtctactccgcctccaccaagggc

SEQ ID NO: 19612 - RNA, 384 nt, synthetic construct
  misc_feature 1..384: note = derived and/or modified sequence opt2 from anti-HIV_Chain
  source 1..384: mol_type = other RNA
caggtccagctcctccccttcggcggcgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccctgccagttccagggccgcgtctccctcacccgccccgcctcctgggacttcgacaccatctccttctacatggacctcaaggccctccgcctcgacgacaccgccgtctacttctgcgcccgccagcgctccgactactgggacttcgacgtctggggctccggcacccaggtcaccgtctcctccgcctccaccaagggc

SEQ ID NO: 19613 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcgtctccctcacccgccaggcctcctgggacttcgacacctactccttctacatggacctcaaggccctccgctccgacgacaccgccatctacttctgcgcccgccagcgctccgacttctgggacttcgacgtctggggctccggcacccaggtcaccgtctcctccgcctccaccaagggc

SEQ ID NO: 19614 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcgtctccctcacccgccaggcctcctgggacttcgacacctactccttctacatggacctcaaggccgtccgctccgacgacaccgccatctacttctgcgcccgccagcgctccgacttctgggacttcgacgtctggggctccggcacccaggtcaccgtctcctccgcctccaccaagggc

SEQ ID NO: 19615 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccagcgctccgactactgggacttcgacgtctggggctccggcacccaggtcaccgtctcctccgcctccaccaagggc

SEQ ID NO: 19616 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccacgcctcctgggacttcgacaccttctccttctacatggacctcaagggcctccgctccgacgacaccgccatctacttctgcgcccgccagcgctccgactactgggacttcgacgtctggggctccggcacccaggtcaccgtctcctccgcctccaccaagggc

SEQ ID NO: 19617 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccacgcctcctgggacttcgacaccttctccttctacatggacctcaaggccctccgctccgacgacaccgccgtctacttctgcgcccgccagcgctccgactactgggacttcgacgtctggggctccggcacccaggtcaccgtctcctccgcctccaccaagggc

SEQ ID NO: 19618 - RNA, 384 nt, synthetic construct
  misc_feature 1..384: note = derived and/or modified sequence opt2 from anti-HIV_Chain
  source 1..384: mol_type = other RNA
cacgtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccaggcctcctgggacttcgacaccttctccttctacatggacctcaaggccctccgcctcgacgacaccgccatctacttctgcgcccgccagcgctccgactactgggacttcgacgtctggggctccggcacccaggtcaccgtctcctccgcctccaccaagggc

SEQ ID NO: 19619 - RNA, 384 nt, synthetic construct
  misc_feature 1..384: note = derived and/or modified sequence opt2 from anti-HIV_Chain
  source 1..384: mol_type = other RNA
caggtccacctctcccactccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccagcgctccgactactgggacttcgacgtctggggctccggcacccaggtcaccgtctcctccgcctccaccaagggc

SEQ ID NO: 19620 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgtcgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccagcgctccgactactgggacttcgacgtctggggctccggcacccaggtcaccgtctcctccgcctccaccaagggc

SEQ ID NO: 19621 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgtcgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacatcgacaccttctccttctacatggacctcaaggccctccgctccgacgacaccgccgtctacttctgcgcccgccaccgctccgactactgggacttcgacgtctggggctccggcacccaggtcaccgtctcctccgcctccaccaagggc

SEQ ID NO: 19622 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgtcgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacatcccccgccagttccagggccgcatctccctcacccgccaggcctccggcgacttcgacaccttctccttctacatggacctcaaggccctccgctccgacgacaccgccgtctacttctgcgcccgccagcgctccgactactgggacttcggcgtctggggctccggcacccaggtcaccgtctcctccgcctccaccaagggc

SEQ ID NO: 19623 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgtcgtcaccaagcccggcgcctccgtccgcgtctcctgcgaggcctccggctacaagatctccggccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccaccgctccgactactgggacttcgacgtctggggctccggcacccaggtcaccgtctcctccgcctccaccaagggc

SEQ ID NO: 19624 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccaccgctccgactactgggacttcgacgtctggggctccggcacccaggtcaccgtctcctccgcctccaccaagggc

SEQ ID NO: 19625 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcgtctccctcacccgccaggcctcctgggacttcgacacctactccttctacatgggcctcaaggccgtccgctccgacgacaccgccatctacttctgcgcccgccagcgctccgacttctgggacttcgacgtctggggctccggcacccaggtcaccgtctcctccgcctccaccaagggc

SEQ ID NO: 19626 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgtcgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccaccgctccgactactgggacttcgacgtctggggctccggcacccaggtcaccgtctcctccgcctccaccaagggc

SEQ ID NO: 19627 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgtcgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcgaggccctccgctccgacgacaccgccgtctacttctgcgcccgccagcgctccgactactgggacttcgacgtctggggctccggcacccaggtcaccgtctcctccgcctccaccaagggc

SEQ ID NO: 19628 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgccgtcaccaagcccggcgcctccgtccgcgtctcctgcgaggcctccggctacaagatccgcgactactccatccactggtggcgccaggcccccggccagggcctccagtgggtcggctggatcaacccccagaccggccagcccaacatcccccgccccttccagggccgcatctccctcacccgccaggcctcctgggacttcgacaccttctccttctacatggacctcgaggccctccgctccgacgacaccgccgtctacttctgcgcccgccagcgctccgactactgggacttcgacgtctggggctccggcacccaggtcaccgtctcctccgcctccaccaagggc

SEQ ID NO: 19629 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgccgtcaccaagcccggcgcctccgtccgcgtctcctgcgaggcctccggctacaagatctccgaccacttcatccactggtggcgccaggcccccggccagggcctccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccagcgctccgactaccgcgacttcgacgtctggggctccggcacccaggtcaccgtctcctccgcctccaccaagggc

SEQ ID NO: 19630 - RNA, 384 nt, synthetic construct
  misc_feature 1..384: note = derived and/or modified sequence opt2 from anti-HIV_Chain
  source 1..384: mol_type = other RNA
caggtccacctctcccagtccggcgccgtcgtcaccaagcccggcgcctccgtccgcgtctcctgcgaggcctccggctacaagatctccgaccacttcatccactggtggcgccaggcccccggccagggcccccagtgggtcggctggatcaaccccaagaccggccagcccaacaacccccgccagttccagggccgcatctccctcacccgccaggcctcctgggacttcgacaccttctccttctacatggacctcaaggccctccgctccgacgacaccgccgtctacttctgcgcccgccaccgctccgactactgggacttcgacgtctggggctccggcacccaggtcaccgtctcctccgcctccaccaagggc

SEQ ID NO: 19631 - RNA, 384 nt, synthetic construct
  misc_feature 1..384: note = derived and/or modified sequence opt2 from anti-HIV_Chain
  source 1..384: mol_type = other RNA
caggtccgcctcctccagtccggcgccgccgtcaccaagcccggcgcctccgtccgcgtctcctgcgaggcctccggctacgagatccgcgactacttcatccactggtggcgccaggcccccggccagggcctccagtgggtcggctggatcaaccccaagaccggccagcccaacaacccccgccagttccagggccgcgtctccctcacccgccaggcctcctgggacttcgactcctactccttctacatggacctcaaggccctccgctccgacgacaccgccgtctacttctgcgcccgccagcgctccgactactgggacttcgacgtctggggctccggcacccaggtcaccgtctcctccgcctccaccaagggc

SEQ ID NO: 19632 - RNA, 384 nt, synthetic construct
  misc_feature 1..384: note = derived and/or modified sequence opt2 from anti-HIV_Chain
  source 1..384: mol_type = other RNA
caggtccgcctcctccagtccggcgccgccgtcaccaagcccggcgcctccgtccgcgtctcctgcgaggcctccggctacgagatccgcgactacttcatccactggtggcgccaggcccccggccagggcctccagtgggtcggctggatcaaccccaagaccggccagcccaacaacccccgccagttccagggccgcgtctccctcacccgccaggcctcctgggacttcgactcctactccttctacatggacctcaaggccctccgctccgacgacaccggcgtctacttctgcgcccgccagcgctccgactactgggacttcgacgtctggggctccggcacccaggtcaccgtctcctccgcctccaccaagggc

SEQ ID NO: 19633 - RNA, 384 nt, synthetic construct
  misc_feature 1..384: note = derived and/or modified sequence opt2 from anti-HIV_Chain
  source 1..384: mol_type = other RNA
caggtccgcctcctccagtccggcgccgccgtcaccaagcccggcgcctccgtccgcgtctcctgcgaggcctccggctacgagatccgcgactacttcatccactggtggcgccaggcccccggccagggcctccagtgggtcggctggatcaaccccaagaccggccagcccaacaacccccgccagttccagggccgcgtctccctcacccgccaggcctcctgggacttcgactcctactccttctacatggacctcaaggccctccgctccgacgacaccgccgtctacttctgcgcccgccagcgctccgactactgggacttcgacgtctggggctccggctcccaggtcaccgtctcctccgcctccaccaagggc

SEQ ID NO: 19634 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccctgccagttccagggccgcgtctccctcacccgccaggcctcctgggacttcgacaccatctccttctacatggacctcaaggccctccgcctcgacgacaccgccgtctacttctgcgcccgccagcgctccgactactgggacttcgacgtctggggctccggcacccaggtcaccgtctcctccgcctccaccaagggc

SEQ ID NO: 19635 - RNA, 384 nt, synthetic construct
  misc_feature 1..384: note = derived and/or modified sequence opt2 from anti-HIV_Chain
  source 1..384: mol_type = other RNA
caggtccagctcctccagtccggcgccgccgtcaccaagcccggcgcctccgtccgcgtctcctgcgaggcctccggctacaacatccgcgactacttcatccactggtggcgccaggcccccggccagggcctccagtgggtcggctggatcaaccccaagaccggccagcccaacaacccccgccagttccagggccgcgtctccctcacccgccacgcctcctgggacttcgacaccttctccttctacatggacctcaaggccctccgctccgacgacaccgccgtctacttctgcgcccgccagcgctccgactactgggacttcgacgtctggggctccggcacccaggtcatcgtctcctccgcctccaccaagggc

SEQ ID NO: 19636 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgacgtcaagaagcccggcgccaccgtcaccgtctcctgcaagaccgacgaggacgaggacgacttccgcgcccacctcatgcagtggatgcgccaggcccccggccagcgcctcgagtgggtcggctggatcaagccccagaccggccagccctcctacggccagaagttccagggccgcgtcaccctcacccgcgaggtctccacctccaccgtcttcctccagctccgcaacctccgctccgacgacaccgccgtctactactgcgcccgcccccgcggcggccgcgacaactggtccttccacgtctggggccgcggcaccctcgtcaccgtctcctccgcctccaccaagggc

SEQ ID NO: 19637 - RNA, 384 nt, synthetic construct
  misc_feature 1..384: note = derived and/or modified sequence opt2 from anti-HIV_Chain
  source 1..384: mol_type = other RNA
gaggtccagctcgtcgagtccggcgccgaggtcaagaagcccggcgcctccgtcaaggtctcctgcaaggtctccggcaactccctcaccgagttctccatccactgggtccgccaggcccccggcaagggcctcgagtggatgggcggcttcgaccccgaggagggcgagaccgtccccgcccagaagttcaagggccgcctcaccatgaccgaggacacctccaccaacaccgcctacatggagctctcctccctccgctccgaggacaccgccgtctactactgctccaccgagccccgcgagatgggcaccctcaccgccggcttcgagtactggggccagggcaccctcgtcaccgtctcctccgcctccaccaagggc

SEQ ID NO: 19638 - RNA, 384 nt, synthetic construct
  misc_feature 1..384: note = derived and/or modified sequence opt2 from anti-HIV_Chain
  source 1..384: mol_type = other RNA
cgcgtccagctcggccagtccggcgccgaggtcaagaagcccggcgcctccgtcaaggtctcctgcaaggtctccggcaactccctcaccgagttctccatccactgggtccgccaggcccccggcaagggcctcgagtggatgggcggcttcgaccccgaggagggcgagaccgtccccgcccagaagttcaagggccgcgtcaccatgaccgaggacacctccaccaacaccgcctacatggagctctcctccctccgctccgaggacaccgccgtctactactgctccaccgagccccgcgagatgggcaccctcaccgccggcttcgagtactggggccagggcaccctcgtcatcgtctcctccgcctccaccaagggc

SEQ ID NO: 19639 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgacgtcaagaagcccggcgcctccgtcaccgtctcctgcaagaccgacgaggacgaggacgacttccgcgcccacctcgtccagtggatgcgccaggcccccggccagcgcctcgagtgggtcggctggatcaagccccagaccggccagccctcctacgcccagaagttccagggccgcgtcaccctcacccgcgaggtctccacctccaccgtcttcctccagctccgcaacctccgctccgacgacaccgccgtctactactgcgcccgcccccgcggcggccgcgacaactggtccttccacgtctggggccgcggcaccctcgtcaccgtctcctccgcctccaccaagggc

SEQ ID NO: 19640 - RNA, 384 nt, synthetic construct
  misc_feature 1..384: note = derived and/or modified sequence opt2 from anti-HIV_Chain
  source 1..384: mol_type = other RNA
caggtccagctccaggagtccggccccggcctcgtcaagccctccgagaccctctccctcacctgctccgtctccggcgcctccatctccaacttctactggacctggatccgccagcccgccggcaagggcctcgagtgggtcggccgcctctactcctccgaccgcaccaactacaacccctccctcaacggccgcgtcaccatgtccctcgacacctccaagaaccagttctccctccgcctcacctccatgaccgacgccgacaccgccatctacttctgcgcccgcgagaagggccagtggctcaccgtccccccctactacttcgactcctggggccagggcatcctcgtcaccgtctcctccgcctccaccaagggc

SEQ ID NO: 19641 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgaggtccgcaagcccggcgcctccgtcaaggtctcctgcaagacctccggctacaccttcaccaactcctacatccactgggtccgccaggcccccggccagggcctcgagtggatgggcatcatcaacccccccggcggcaacacctactacgcccagaagttccacggccgcgtcaccctcacccgcgacacctccacctccaccgtctacatggagctcaactccctccgctccgaggacaccgccgtctacttctgcgcccgcccccactcccccaccaacatcccctcccgccccctcgactactggggccagggcaccctcgtcaccgtctcctccgcctccaccaagggc

SEQ ID NO: 19642 - RNA, 384 nt, synthetic construct
  misc_feature 1..384: note = derived and/or modified sequence opt2 from anti-HIV_Chain
  source 1..384: mol_type = other RNA
caggtccagctccaggagtccggccccggcctcgtcaagccctccggcaccctctccctcacctgcaacgtctacggcggctccatgatctcctactactggtcctggatccgccagccccccggcaagggcctcgagtggatcggccacgtctacaactccggcaacaccaagtactccccctccctcaagaaccgcgtcaccatctccatggacacctcccgcaacctcttctccctcaaggtcacctccgtcacccccgccgacaccgccgtctactactgcgcccgcgccgactacgacaacatctgggactcccgcggcggcttcgacctctggggccagggcaccctcgtcaccgtctcctccgcctccaccaagggc

SEQ ID NO: 19643 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgaggtcaagaagcccggctcctccgtcaaggtctcctgcaaggcctccggcggcaccctctcctcctacaccatctcctgggtccgccaggcccccggccagggcctcgagtggatgggccgcctcatccccctcgtcgacatcaccacctacgcccagaagttccagggccgcgtcaccatcaccgccgacacctccaccaacaccgcctacatggagctctccaacctccgctccgaggacaccgccatctaccactgcgccacctccaccatgatcgccgccgtcatcaacgacgccttcgacctctggggccagggcaccaccgtcaccgtctcctccgcctccaccaagggc

SEQ ID NO: 19644 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgaggtcaagaagcccggcgcctccgtcaagatctcctgcaaggcctccggctactccttccgcaactacgccgtccactgggtccgccaggcccccggccagggcctcgagtggatgggcgagatcaacggcggcaacggcaacaccgagtactcccagaagtcccagggccgcctcaccatcacccgcgacatctccgccaccaccgcctacatggagctctcctccctccgctccgacgacaccgccgtctactactgcgcccgcgtcgcctacgtccacgtcgtcaccacccgctccctcgacaactggggccagggcaccctcgtcaccgtctcctccgcctccaccaagggc

SEQ ID NO: 19645 - RNA, 384 nt, synthetic construct
  misc_feature 1..384: note = derived and/or modified sequence opt2 from anti-HIV_Chain
  source 1..384: mol_type = other RNA
caggtccgcctctcccagtccggcgccgccgtcatgaagaccggcgcctccgtcaccatctcctgcgagaccgagggcttcaacttcgtcaactacatcatccactgggtccgccgcccccccggccgcggcttcgagtggctcggcatgatcgacccccgcaacggccacccctggttcgcccagaccgtccgcggccgcctctccctccgccgcgacaccttcaacgagatcgtctacatgaccctctccggcctcaccaccgacgacaccggcctctacttctgcgcccgcaacgagccccagtaccactccctccccggcatgttcgactactggggccagggcacccccgtcaccgtctcctccgcctccaccaagggc

SEQ ID NO: 19646 - RNA, 384 nt, synthetic construct
  misc_feature 1..384: note = derived and/or modified sequence opt2 from anti-HIV_Chain
  source 1..384: mol_type = other RNA
caggtccgcctctcccagtccggcgccgccgtcgtcaagaccggcgcctccgtcaccatctcctgcgagaccgagggctacaacttcgtcaactacatcatccactgggtccgccgcccccccggccgcggcttcgagtggctcggcatgatcgacccccgcaacggccacccctggttcgcccagaccgtccgcggccgcctctccctccgccgcgacaccttcaaggagaccgtctacatgaccctctccggcctcacctccgacgacaccggcgtctacttctgcgcccgcaacgagccccagtaccactccctccccggcatgttcgactactggggccacggcacccccgtcaccgtctcctccgcctccaccaagggc

SEQ ID NO: 19647 - RNA, 384 nt, synthetic construct
  misc_feature 1..384: note = derived and/or modified sequence opt2 from anti-HIV_Chain
  source 1..384: mol_type = other RNA
cagggccagctcgtccagtccggcggcggcgtcaagaagctcggcacctccgtcaccatctcctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccacctcc

SEQ ID NO: 19648 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgaggtcaagaagcccggcgcctccgtcaaggtctcctgcaaggcctccggctacaccttcacctcctacgacatcaactgggtccgccaggccaccggccagggcctcgagtggatgggctggatgaaccccaactccggcaacaccggctacgcccagaccttccagggccgcgtcaccatgacccgcaacacctccatctccaccgcctacatggagctctcctccctccgctccgaggacaccgccgtctactactgcgcccgcgaccgctggctcccccagtactactactacggcatggacgtctggggccagggcaccaccgtcaccgtctcctccgcctccaccaagggc

SEQ ID NO: 19649 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgaggtcaagaagcccggctcctccatgaaggtctcctgcaagtcctccggcggcaccttctccaaccacgccatctcctgggtccgccaggcccccggcaagggcctcgagtggatgggcggcatcatccccatgtccggcaccaccaactacctccagaagttccagggccgcgtcaccatcaccgccgacgagttcgccaccaccgcctacatggagctctcctccctcacctccgaggacaccgccgtctactactgcgcccgcgcccgcgccgactcccacacccccatcgacgccttcgacatctggggccccggcacccgcgtcatcgtctcctccgcctccaccaagggc

SEQ ID NO: 19650 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgaggtcaagaagcccggcgcctccgtcaaggtctcctgcaaggtctccggctacaccctcaccgagctctccatccactgggtccgccaggcccccggcaagcgcctcgagtggatgggcggcttcgaccccgaggacggcgagcgcatctacgcccagaagttccagggccgcgtcaccatgaccgaggacacctccaccgacaccgcctacatggagctcaactccctccgctccgacgacaccgccgtctactactgcgccaccggcggcctctactgctcctccatctcctgcatcatggacgtctggggccagggcaccaccgtcaccgtctcctccgcctccaccaagggc

SEQ ID NO: 19651 - RNA, 384 nt, synthetic construct
  misc_feature 1..384: note = derived and/or modified sequence opt2 from anti-HIV_Chain
  source 1..384: mol_type = other RNA
caggtccagctcgtccagtccggcgccgaggtcaagatgcccggcgcctccgtcaaggtctcctgcaaggtctccggctactccctcaccgagctctccatccactgggtccgccaggcccccggcaagcgcctcgagtggatgggcggcttcgaccccgaggacgacgagcgcatctacgcccagaagttccaggaccgcgtcaccatgaccgaggacacctccaccgacaccgcctacatggacctcaactccctccgctccgaggacaccgccgtctactactgcaccaccggcggcctctactgctcctccatctcctgcatcatggacgtctggggccagggcaccaccgtcatcgtctcctccgcctccaccaagggc

SEQ ID NO: 19652 - RNA, 387 nt, synthetic construct
  misc_feature 1..387: note = derived and/or modified sequence opt2 from anti-HIV_Chain
  source 1..387: mol_type = other RNA
gaggtccagctctccgagtccggcggcggcttcgtcaagcccggcggctccctccgcctctcctgcgaggcctccggcttcaccttcaacaactacgccatgtcctgggtccgccaggcccccggcaagggcctcgagtgggtctccgtcacctccgcccacggcggctccgcctactacggcgagttcgtcaagggccgcttcaccatgtcccgcgaccacttcatcgacaccgtctacctcgagatgaacggcctcaccgtcgaggacaccgccgtctactactgcgtccgcgtcaccttctaccacgagggctccggctactactaccgcgccggcaactacttcgactcctggggcaagggcacccgcgtcgtcgtctccgcc

SEQ ID NO: 19653 - RNA, 387 nt, synthetic construct
  misc_feature 1..387: note = derived and/or modified sequence opt2 from anti-HIV_Chain
  source 1..387: mol_type = other RNA
gaggtccagctctccgagtccggcggcggcttcgtcaagcccggcggctccctccgcctctcctgcgaggcctccggcttcaccttcaacaactacgccatgtcctgggtccgccaggcccccggcaagggcctcgagtgggtctccgtcacctccgcccacggcggctccgcctactacggcgagttcgtcaagggccgcttcaccatgtcccgcgaccacttcatcgacaccgtctacctcgagatgaaccgcctcaccgtcgaggacaccgccgtctactactgcgtccgcgtcaccttctaccacgagggctccggctactactaccgcgccggcaactacttcgactcctggggcaagggcacccgcgtcgtcgtctccgcc

SEQ ID NO: 19654 - RNA, 387 nt, synthetic construct
  misc_feature 1..387: note = derived and/or modified sequence opt2 from anti-HIV_Chain
  source 1..387: mol_type = other RNA
gaggtccagctctccgagtccggcggcggcgtcgtcaagcccggcggctccctccgcctctcctgcgaggcctccggcttcaccttctccaactacgccatgtcctgggtccgccaggcccccggcaagggcctcgagtgggtctccgtcaccggcggccacggcacctacggctactacggcgagttcgtcaagggccgcttcaccatctcccgcgaccactccatggacaccgtctacctccagatgaaccgcctccgcgtcgaggacaccgccgtctactactgcgtccgcaccccctactaccacgagtcctccggctactactaccgcgccggcaactacttcgacttctggggcaagggcaccctcgtcatcgtctccgcc

SEQ ID NO: 19655 - RNA, 387 nt, synthetic construct
  misc_feature 1..387: note = derived and/or modified sequence opt2 from anti-HIV_Chain
  source 1..387: mol_type = other RNA
gaggtccagctctccgagtccggcggcggcttcgtcaagcccggcggctccctccgcctctcctgcgaggcctccggcttcaccttcaacaactacgccatgggctgggtccgccaggcccccggcaagggcctcgagtgggtctccgtcacctccgcccacggcggctccgcctacttcggcgagttcgtcaagggccgcttcaccatgtcccgcgaccacttcatcgacaccgtctacctcgagatgaaccgcctcaccgtcgaggacaccgccgtctactactgcgtccgcgtcaccttctaccacgagggctccggctactactaccgcgccggcaactacttcgactcctggggccagggcaccctcgtcatcgtctccgcc

SEQ ID NO: 19656 - RNA, 387 nt, synthetic construct
  misc_feature 1..387: note = derived and/or modified sequence opt2 from anti-HIV_Chain
  source 1..387: mol_type = other RNA
caggtccagctcgtcgagtccggcggcggcctcgtccagcccggcggctccctccgcctctcctgcgccgcctccggcttcaccttctccacccactggatgcactgggtccgccaggcccccggcaagggcctcgtctgggtctcccgcatccactccgacggccgctccacctcctacgccgactccgtcaagggccgcttcaccatctcccgcgacaacgccaagaacaccctctacctccagatgaactccctccgcgccgaggacaccgccgtctactactgcgcccgcggcgccgccgtcttcggcgtcgtcatcatcggcggcatggacctctggggccagggcaccaccgtcaccgtctcctccgcctccaccaagggc

SEQ ID NO: 19657 - RNA, 387 nt, synthetic construct
  misc_feature 1..387: note = derived and/or modified sequence opt2 from anti-HIV_Chain
  source 1..387: mol_type = other RNA
caggtccagctcgtcgagtccggcggcgccctcgtccagcccggcggctccctccgcctctcctgcgccgcctccggcttctccttctcctcctacgccatgtcctgggtccgccaggcccccggcaagggcctcgagtgggtctccgccatctcccgctccggcggctccacctactacgccgactccgtcaagggccgcttcaccatctccatcgacaactccaacaacaccctctacctccagatgaactccctccgcgtcgaggacaccgccgtctactactgcgccaagcgcgaggccttctactacggcgccggcggctacggcatggacgtctggggccagggcaccaccgtcaccgtctcctccgcctccaccaagggc

SEQ ID NO: 19658 - RNA, 387 nt, synthetic construct
  misc_feature 1..387: note = derived and/or modified sequence opt2 from anti-HIV_Chain
  source 1..387: mol_type = other RNA
ttccagggccacctcgtccagtccggcggcggcgtcaagaagcccggcacctccgtcaccctctcctgcctcgcctccgagtacaccttcaccgagttcaccatccactggatccgccaggcccccggccagggccccctctggctcggcctcatcaagcgctccggccgcctcatgacctcctaccgcttccaggaccgcctctccctccgccgcgaccgctccaccggcaccgtcttcatggagctccgctccctccgcaccgacgacaccgccgtctactactgcgcccgcgacggcctcggcgagctcgcccccgcctaccactacggcatcgacgcctggggccagggcaccaccgtcatcgtcacctccgcctccacctcc

SEQ ID NO: 19659 - RNA, 387 nt, synthetic construct
  misc_feature 1..387: note = derived and/or modified sequence opt2 from anti-HIV_Chain
  source 1..387: mol_type = other RNA
cagggcctcctcgtccagtccggcggcggcgtcaagaagctcggcacctccgtcaccatctcctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccaccaagggc

SEQ ID NO: 19660 - RNA, 387 nt, synthetic construct
  misc_feature 1..387: note = derived and/or modified sequence opt2 from anti-HIV_Chain
  source 1..387: mol_type = other RNA
aacttcatgctcacccagcccgcctccgtctccggctcccccggccagtccatcaccatctcctgctccggcaccggctccgacatcggcgtctacaactacgtctcctggtaccagcagcaccccggcaaggccccccgcctcatgatctacgacgtcaccaaccgcccctccggcgtctccaaccgcttctccggctccaagtccggcttcaccgcctccctcaccatctccggcctccagggcgacgacgaggccgactactactgctcctcctactcctccaccaacacctacgtcttcggcaccggcacccacgtcaccgtcctcggccagcccaaggccaaccccaccgtcaccctcttccccccctcctccgaggagctc

SEQ ID NO: 19661 - RNA, 387 nt, synthetic construct
  misc_feature 1..387: note = derived and/or modified sequence opt2 from anti-HIV_Chain
  source 1..387: mol_type = other RNA
cagtccgccctcacccagccccgctccgtctccggctcccccggccagtccgtcaccatctcctgcaccggcacctcctccgacgtcggcgcctacaactacgtctcctggtaccgccagcaccccggcaaggcccccaagctcatgatcaacgacgtctccaagcgcccctccggcgtccccgaccgcttctccggctccaagtccggcaacaccgcctccctcaccatctccggcctccaggccgaggacgaggccgactactactgctgctcctacgccggcacctactcctacgtcttcggcaccggcaccaaggtcaccgtcctcggccagcccaaggccaaccccaccgtcaccctcttccccccctcctccgaggagctc

SEQ ID NO: 19662 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcctcaagaagcccggcacctccgtcaccatctcctgcctcgcctccgagtacaccttcaacgagttcgtcatccactggatccgccaggcccccggccagggccccctctggctcggcctcatcaagcgctccggccgcctcatgaccgcctacaacttccaggaccgcctctccctccgccgcgaccgctccaccggcaccgtcttcatggagctccgcggcctccgccccgacgacaccgccgtctactactgcgcccgcgacggcctcggcgaggtcgcccccgactaccgctacggcatcgacgtctggggccagggctccaccgtcatcgtcaccgccgcctccaccaagggc

SEQ ID NO: 19663 - RNA, 387 nt, synthetic construct
  misc_feature 1..387: note = derived and/or modified sequence opt2 from anti-HIV_Chain
  source 1..387: mol_type = other RNA
aacttcatgctcacccagcccccctccgcctccggcgcccccggccagcgcgtcaccatctcctgctccggcggcccctccaacgtcggcggcaactacgtctactggtaccgccagttccccggcaccgcccccaacctcctcatcctccgcgacgaccagcgcccctccggcgtccccgaccgcttctccgcctccaagtccggcaactccgcctccctcgccatctccggcctccgccccgacgacgaggccttctacttctgcgccacctacgactccgacggctccatccgcctcttcggcggcggcaccaccctcaccgtcctctcccagcccaaggccgccccctccgtcaccctcttccccccctcctccgaggagctc

SEQ ID NO: 19664 - RNA, 387 nt, synthetic construct
  misc_feature 1..387: note = derived and/or modified sequence opt2 from anti-HIV_Chain
  source 1..387: mol_type = other RNA
cagctcgtcctcacccagcccccctccgtctccggcgcccccggccagcgcgtcaccatctcctgctccggcggcccctccaacgtcggcggcaacctcgtctactggtacaagcagttccccggcaccgcccccaagctcctcatccgccgcgacgaccagcgcccctccggcgtccccgaccgcttctccggctccaagtccggcaactccgcctccctcaccatctccggcctccgccccgacgacgaggccttctacttctgcgccacctacgactcccagggctccacccgcctcttcggcggcggcaccgtcctcaccgtcctctcccagcccaaggccgccccctccgtcaccctcttccccccctcctccgaggagctc

SEQ ID NO: 19665 - RNA, 387 nt, synthetic construct
  misc_feature 1..387: note = derived and/or modified sequence opt2 from anti-HIV_Chain
  source 1..387: mol_type = other RNA
aacttcatgctcacccagcccccctccgtctccggcgcccccggccagcgcgtcaccatctcctgctccggcggcccctccaacgtcggcggcaacctcgtctactggtacaagcagttccccggcaccgcccccaagctcctcatccgccgcgacgaccagcgcccctccggcgtccccgaccgcttctccggctccaagtccggcaactccgcctccctcgccatctccggcctccgccccgacgacgaggccttctacttctgcgccacctacgactcccacggctccatccgcctcttcggcggcggcaccctcctcaccgtcctctcccagcccaaggccgccccctccgtcaccctcttccccccctcctccgaggagctc

SEQ ID NO: 19666 - RNA, 387 nt, synthetic construct
  misc_feature 1..387: note = derived and/or modified sequence opt2 from anti-HIV_Chain
  source 1..387: mol_type = other RNA
cagtccgccctcacccgcaccccctccgtctccggcgcccccggccagcgcgtcaccatctcctgctccggcggcccctccaacgtcggcggcaactacgtctactggtaccagcagttccccggcgccgcccccaagctcctcatccgccgcgacgaccagcgcccctccggcgtccccgaccgcttctccggctccaagtccggcaactccgcctccctcgccatctccggcctccgcctcgacgacgaggcctactacttctgcgccacctacgactccggctggtccatccgcctcttcggcggcggcacccgcctcaccgtcctctcccagcccaaggccgccccctccgtcaccctcttccccccctcctccgaggagctc

SEQ ID NO: 19667 - RNA, 387 nt, synthetic construct
  misc_feature 1..387: note = derived and/or modified sequence opt2 from anti-HIV_Chain
  source 1..387: mol_type = other RNA
cagtccgccctcacccagcccccctccgtctccgccacccccggccagaccgtcaccatctcctgctccggctccggctccaacgtcggcggcaaccacgtctactggtaccgccagctccccggcgccgcccccaccctcctcatctccaagaccgaccaccgcccctcccgcgtccccgaccgcttctccgcctccaagtccggcaactccgcctccctcgccatctccggcctccgccccgacgacgaggccatctacttctgcgccacctacgacaccggcctctccctccgcctcttcggcggcggcacccgcctcaccgtcctctcccagcccaaggccgccccctccgtcaccctcttccccccctcctccgaggagctc

SEQ ID NO: 19668 - RNA, 387 nt, synthetic construct
  misc_feature 1..387: note = derived and/or modified sequence opt2 from anti-HIV_Chain
  source 1..387: mol_type = other RNA
caggtccagctcctcgagtccggccccggcctcgtcaccccctccggcaccctctccctcgcctgcgccgtctccggcgcctccatctcctcctcccactggtggacctgggtccgccagtcccccggcaagggcctcgagtggatcggcgagatcgaccgccgcggcaccaccaactacaacccctccctccgctcccgcgtcaccatcctcctcgacaactccaagaaccagttctccctctccctccgctccgtcaccgccgccgacaccgccgtctactactgcaccaaggtctacgccggcctcttcaacgagcgcacctacggcatggacgtctggggccacggcaccaccgtcctcgtctcctccgcctccaccaagggc

SEQ ID NO: 19669 - RNA, 387 nt, synthetic construct
  misc_feature 1..387: note = derived and/or modified sequence opt2 from anti-HIV_Chain
  source 1..387: mol_type = other RNA
caggccgtcgtcacccagcccccctccgtctccgccacccccggccagaccgtcaccatctcctgctccggctccggctccaacgtcggcggcaaccacgtctactggtaccgccagctccccggcgccgcccccaccctcctcatctccaagaccaaccgccgcccctcccaggtccccgaccgcttctccggctccaagtccggcaactccgcctccctcgccatctccggcctccgccccgacgacgaggccgactacttctgcgccacctacgacaccgacctctccctccgcctcttcggcggcggcacccgcctcaccgtcctctcccagcccaaggccgccccctccgtcaccctcttccccccctcctccgaggagctc

SEQ ID NO: 19670 - RNA, 387 nt, synthetic construct
  misc_feature 1..387: note = derived and/or modified sequence opt2 from anti-HIV_Chain
  source 1..387: mol_type = other RNA
cagtccgccctcacccagcccccctccgtctccggcacccccggccagaacgtcaccatctcctgctccggcggcggctccgacgtcggcggcaacctcgtctcctggtaccagcacttccccggcgccgcccccaagctcctcatccaccgcgacaaccagcgcccctccggcgtccccgaccgcttctccgccctcaagtccggcaactccgcctccctcgccatctccggcctccgctccgacgacgaggccttctacttctgcgccgtctacgactcctccctctccctcggcctcttcggcggcggcaccaagctcaccgtcctctcccagcccaaggccgccccctccgtcaccctcttccccccctcctccgaggagctc

SEQ ID NO: 19671 - RNA, 387 nt, synthetic construct
  misc_feature 1..387: note = derived and/or modified sequence opt2 from anti-HIV_Chain
  source 1..387: mol_type = other RNA
cagtccgccctcacccagcccccctccgcctccggcacccccggccagcgcgtcaccatctcctgctccggcggcggctccaacatcggcggcaacctcgtctcctggtaccagcacttccccggcaccgcccccaagctcctcatctaccgcaacgaccagcgcccctccggcgtccccgaccgcttctccggctccaagtccggcacctccgcctccctcaccatctccggcctccgctccgacgacgaggccacctacttctgcgccgcctacgactcctccctctccctccgcctcttcggcggcggcaccaccctcaacgtcctctcccagcccaaggccgccccctccgtcaccctcttccccccctcctccgaggagctc

SEQ ID NO: 19672 - RNA, 387 nt, synthetic construct
  misc_feature 1..387: note = derived and/or modified sequence opt2 from anti-HIV_Chain
  source 1..387: mol_type = other RNA
cagtccgccctcacccagcccccctccgtctccgccacccccggccagaccgtcaccatctcctgctccggctccggctccaacgtcggcggcaaccacgtctactggtaccgccagctccccggcgccgcccccaccctcctcatctccaagaccaaccaccgcccctcccaggtccccgaccgcttctccgcctccaagtccggcaactccgcctccctcgccatctccggcctccgccccgacgacgaggccgactacttctgcggcacctacgacacctccctctccctccgcctcttcggcggcggcacccgcctcaccgtcctctcccagcccaaggccgccccctccgtcaccctcttccccccctcctccgaggagctc

SEQ ID NO: 19673 - RNA, 387 nt, synthetic construct
  misc_feature 1..387: note = derived and/or modified sequence opt2 from anti-HIV_Chain
  source 1..387: mol_type = other RNA
cagtccgtcctcacccaggtcctctccgtctccggcacccccggccagcgcgtcatcatctcctgctccggcacctcctccaacgtcggcggcaacctcgtctcctggtaccagcacctccccggcgccgccccccgcctcctcatccaccgcgacgaccagcgcccctccggcgtccccgaccgcttctccggctccaagtccggcaactccgcctccctcgtcatctccggcctccgctccgacgacgaggccgactacttctgcggcgcctacgactccaccttctccctccccgtcttcggcggcggcacccgcctcaccgtcctctcccagcccaaggccgccccctccgtcaccctcttccccccctcctccgaggagctc

SEQ ID NO: 19674 - RNA, 387 nt, synthetic construct
  misc_feature 1..387: note = derived and/or modified sequence opt2 from anti-HIV_Chain
  source 1..387: mol_type = other RNA
cagtccgccctcacccagccccccgccacctccggcacccccggccagcgcgtcaccatctcctgctccggcggcggctccaacgtcggcggcaacctcgtctcctggtaccagcagttccccggcgccgcccccaagctcatcctccaccgcgacggccagcgcccctccggcgtccccgaccgcttctccgcctccaagtccggcacctccgcctccctcaccatctccggcctccgctccgacgacgaggccacctacttctgcgccgccttcgactccgccctctccctccccctcttcggcggcggcaccaagctcaccgtcctctcccagcccaaggccgccccctccgtcaccctcttccccccctcctccgaggagctc

SEQ ID NO: 19675 - RNA, 387 nt, synthetic construct
  misc_feature 1..387: note = derived and/or modified sequence opt2 from anti-HIV_Chain
  source 1..387: mol_type = other RNA
cagctcgtcctcacccagcccccctccgtctccgccacccccggccagaccgtcaccatctcctgctccggctccggctccaacgtcggcggcaaccacgtctactggtaccgccagctccccggcgccgcccccaccctcgtcatctccaagaccgaccaccgcccctcccgcgtccccgaccgcttctccggctccaagtccggcaactccgcctccctcgccatctccggcctccgccccgacgacgaggccgcctacttctgcgccacctacgacaccggcctctccctccgcctcttcggcggcggcacccgcctcgccgtcctctcccagcccaaggccgccccctccgtcaccctcttccccccctcctccgaggagctc

SEQ ID NO: 19676 - RNA, 387 nt, synthetic construct
  misc_feature 1..387: note = derived and/or modified sequence opt2 from anti-HIV_Chain
  source 1..387: mol_type = other RNA
cagtccgccctcacccagcccccctccgtctccggcacccccggccagaacgtcaccatctcctgctccggcggcggctccaacgtcggcggcaacctcgtctcctggtaccagcacttccccggcgccgcccccaagctcctcatccaccgcgacaaccagcgcccctccggcgtccccgaccgcttctccgtcctcaagtccggcaactccgcctccctcgccatctccggcccccgctccgacgacgaggccttctacttctgcgccgtctacgactcctccctctccctcggcctcttcggcggcggcaccaagctcaccgtcctctcccagcccaaggccgccccctccgtcaccctcttccccccctcctccgaggagctc

SEQ ID NO: 19677 - RNA, 387 nt, synthetic construct
  misc_feature 1..387: note = derived and/or modified sequence opt2 from anti-HIV_Chain
  source 1..387: mol_type = other RNA
cagaccgtcgtcacccagcccccctccgcctccggcacccccggccagcgcgtcaccatctcctgctccggcggcggctccaacatcggcggcaacctcgtctcctggtaccagcacttccccggcgccgcccccaagctcctcatctaccgcaacgaccagcgcccctccggcgtccccgaccgcttctccggctccaagtccggcacctccgcctccctcaccatctccggcctccgctccgacgacgaggccacctacttctgcgccgcctacgactgcaccctctccctccgcctcttcggcggcggcaccaccctcaacgtcctctcccagcccaaggccgccccctccgtcaccctcttccccccctcctccgaggagctc

SEQ ID NO: 19678 - RNA, 387 nt, synthetic construct
  misc_feature 1..387: note = derived and/or modified sequence opt2 from anti-HIV_Chain
  source 1..387: mol_type = other RNA
cagtccgccctcacccagaccccctccgtctccggcgcccccggccagcgcgtcaccatctcctgctccggcggcccctccaacgtcggcggcaactacgtctactggtaccagcagttccccggcgccgcccccaagctcctcatccgccgcgacgaccagcgcccctccggcgtccccgaccgcttctccggctccaagtccggcaactccgcctccctcgccatctccggcctccgcctcgacgacgaggcctactacttctgcgccacctacgactccggctggtccatccgcctcttcggcggcggcacccgcctcaccgtcctctcccagcccaaggccgccccctccgtcaccctcttccccccctcctccgaggagctc

SEQ ID NO: 19679 - RNA, 387 nt, synthetic construct
  misc_feature 1..387: note = derived and/or modified sequence opt2 from anti-HIV_Chain
  source 1..387: mol_type = other RNA
cagtccgtcctcacccagcccccctccgcctccggcgcccccggccagcgcgtcaccatctcctgctccggcggcccctccaacgtcggcggcaactacgtctactggtaccgccagttccccggcaccgcccccaacctcctcatcctccgcgacgaccagcgcccctccggcgtccccgaccgcttctccgcctccaagtccggcaactccgcctccctcgccatctccggcctccgccccgacgacgaggccttctacttctgcgccacctacgactccgacggctccgtccgcctcttcggcggcggcaccaccctcaccgtcctctcccagcccaaggccgccccctccgtcaccctcttccccccctccaacggcggccgc

SEQ ID NO: 19680 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagcccggcacctccgtcaccatctcctgcctcgcctccgagtacaccttcaacgagttcgtcatccactggatccgccaggcccccggccagggccccctctggctcggcctcatcaagcgctccggccgcctcatgacctcctacaagttccaggaccgcctcaacctccgccgcgaccgctccaccggcaccgtcttcatggagctccgcggcctccgccccgacgacaccgccgtctactactgcgcccgcgacggcctcggcgaggtcgcccccgactaccgctacggcatcgacgtctggggccagggctccaccgtcatcgtcaccgccgcctccaccaagggc

SEQ ID NO: 19681 - RNA, 387 nt, synthetic construct
  misc_feature 1..387: note = derived and/or modified sequence opt2 from anti-HIV_Chain
  source 1..387: mol_type = other RNA
gaggtccagctcgtcgagtccggcgccgaggtcaagaagcccggcgcctccgtcaaggtcgcctgcaaggtctccggcaagaagctctccgacctctccatccactgggtccgccaggcccccggcaagggcctcgagtggatgggcggcttcgacgaggaggacggcaagatctcctacgagcgcaagttccagggccgcgtcaccatgaccgaggacaccgcccgcgacaccgccttcatggagatgtcctccctccgctccgacgacaccgccgtctacttctgcgccgccgccccccgcctcgacctcggcgagctctcctccggcttccacttctggggcctcggcaccctcgtctccgtctcctccgcctccaccaagggc

SEQ ID NO: 19682 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcggcaagaagctcggcacctccgtcaccatctcctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtctcctccgcctccaccaagggc

SEQ ID NO: 19683 - RNA, 387 nt, synthetic construct
  misc_feature 1..387: note = derived and/or modified sequence opt2 from anti-HIV_Chain
  source 1..387: mol_type = other RNA
gaggtccagctcgtcgagtccggcgccgaggtcaagaagcccggcgcctccgtcaaggtctcctgcaaggtctccggctacaccctctccgacctctccatgcactgggtccgccaggcccccggcaagggcctcgagtggatgggcggcttcgacgaggaggacggcgagatcacctacgcccagaagttccagggccgcgtctccatgaccgaggacacctcccgcgacaccgcctacatggagctctcctccctccgctccgaggacaccgccgtctactactgcgccaccgccccccgcctcgagctcggcgagctctcctccggcttccactactggggcctcggcaccctcgtcaccgtctcctccgcctccaccaagggc

SEQ ID NO: 19684 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagaccggcacctccgtcaccatctcctgcctcgcctccgagtacaccttcaccgagttcaccatccactggatccgccaggcccccggccagggccccctctggctcggcctcatcaagcgctccggccgcctcatgaccgccaaccgcttccaggaccgcctctccctccgccgcgaccgctccaccggcaccgtcttcatggagctccgctccctccgcatcgacgacaccgccgtctactactgcgcccgcgacggcctcggcgagctcgcccccgcctaccactacggcatcgacgtctggggccagggcaccaccatcatcgtcacctccgcctccaccaagggc

SEQ ID NO: 19685 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagctcggcacctccgtcaccatctcctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccaccaagggc

SEQ ID NO: 19686 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagctcggcacctccgtcaccatcccctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccaccaagggc

SEQ ID NO: 19687 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagcccggcacctccgtcaccatctcctgcctcgcctccgagtacaccttcaacgagttcgtcatccactggatccgccaggcccccggccagggccccgtctggctcggcctcatcaagcgctccggccgcctcatgacctcctacaagttccaggaccgcctctccctccgccgcgaccgctccaccggcaccgtcttcatggagctccgcggcctccgcctcgacgacaccgccgtctactactgcgcccgcgacggcctcggcgaggtcgcccccgcctacctctacggcatcgacgcctggggccagggctccaaggtcatcgtcacccccgcctccaccaagggc

SEQ ID NO: 19688 - RNA, 387 nt, synthetic construct
  misc_feature 1..387: note = derived and/or modified sequence opt2 from anti-HIV_Chain
  source 1..387: mol_type = other RNA
caggcccgcctcgaccagtggggcaccggcctcctcaagccctccgagaccctctccctcaagtgcgccgtcttcggcgtcctcttcaccgactacaactggacctgggtccgccagtcccccggcaaggagctcgagtggatcggccacctcgaccaccgcggcggcggcaactacaacccctccctcgagtcccgcgtcaccatctccctcgactactccaaggcccagttctccctccacctcaagtccgtcaccgtcgccgacaccgcccgctactactgcgccggcgccgtcaagggcttctggttcgacgacccctacacctggttcggcccctggtcccagggcaccctcgtcaccgtcgcctccgcctccaccaagggc

SEQ ID NO: 19689 - RNA, 387 nt, synthetic construct
  misc_feature 1..387: note = derived and/or modified sequence opt2 from anti-HIV_Chain
  source 1..387: mol_type = other RNA
caggcccgcctcgaccagtggggcaccggcctcctcaagccctccgagaccctctccctcaagtgcgccgtcttcggcgtcctcttcaccgactacaactggacctgggtccgccagtcccccggcaagggcctcgagtggatcggccacctcgaccaccgcggcggcggctcctacaacccctccctcgagtcccgcgtctccatctccctcgactactccaaggcccagttctccctccacctcaagtccgtcaccgtcgccgacaccgccctctactactgcgccggcgccgtcaagggcttctggttcgacgagccctccacctggttcggcccctggtcccagggcaccatggtcaccgtcgcctccgcctccaccaagggc

SEQ ID NO: 19690 - RNA, 387 nt, synthetic construct
  misc_feature 1..387: note = derived and/or modified sequence opt2 from anti-HIV_Chain
  source 1..387: mol_type = other RNA
cagggccacctcgtccagtccggcggcggcgtcaagaagctcggcacctccgtcaccatctcctgcctcgcctccgaggacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccaccaagggc

SEQ ID NO: 19691 - RNA, 387 nt, synthetic construct
  misc_feature 1..387: note = derived and/or modified sequence opt2 from anti-HIV_Chain
  source 1..387: mol_type = other RNA
caggtccagctcgtccagtccgaggccgaggtcaagaagcccggctcctccgtcaaggtctcctgcaaggcctccggcggcaccttccgcggctacaccatctcctgggtccgccaggcccccggccagggcctcgagtggatgggccgcatcatccccatcctcggcaaggccatctacgccccctccttccagggccgcgtcaccctcaccgccgacaagtccaccggcaccgcctacatggagctctcccgcctccgctccgacgacaccgccgtctactactgcgccaaggtcaagatgcgcggctcctccggctactactacctcttcgacgactggggccagggcaccctcgtcaccgtctcctccgcctccaccaagggc

SEQ ID NO: 19692 - RNA, 387 nt, synthetic construct
  misc_feature 1..387: note = derived and/or modified sequence opt2 from anti-HIV_Chain
  source 1..387: mol_type = other RNA
caggcccgcctcgaccagtggggcaccggcctcctcaagccctccgagaccctctccctcaagtgcgccgtcttcggcgtcctcttcaccgactacaactggacctgggtccgccagtcccccggcaagggcctcgagtggatcggccacctcgaccaccgcggcggcggcaactacaacccctccctcgagtcccgcgtcaccatctccctcgactactccaaggcccagttctccctccacctcaagtccgtcaccgtcgccgacaccgccctctactactgcgccggcgccgtcaagggcttctggttcgacgaggtctacaactggttcggcccctggtcccagggcaccctcgtcaccgtcgcctccgcctccaccaagggc

SEQ ID NO: 19693 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagcccggcacctccgtcaccatctcctgcctcgcctccgagtacaccttcaccgagttcaccatccactggatccgccaggcccccggccagggccccctctggctcggcctcatcaagcgctccggccgcctcatgaccgcctaccgcttccaggaccgcctctccctccgccgcgaccgctccaccggcaccgtcttcatggagctccgcaacctccgcatggacgacaccgccgtctactactgcgcccgcgacggcctcggcgagctcgcccccgcctaccagtacggcatcgacgtctggggccagggcaccaccgtcatcgtctcctccgcctccaccaagggc

SEQ ID NO: 19694 - RNA, 387 nt, synthetic construct
  misc_feature 1..387: note = derived and/or modified sequence opt2 from anti-HIV_Chain
  source 1..387: mol_type = other RNA
caggtccgcctcgtccagtccggcccccaggtcaagcgccccggcgcctccatccgcctctcctgcgagtcctccggctaccgcttccaggactacatcgtcgcctggatccgccagacccgcggccagggcttcgagttcgtcggcatggtcaacccccgcggcggccgcccctggccctcctcccgcttccgcgaccgcgtcaccctcacccgcgacatcgagtccgagaccttctacctcggcctcaacgacctcacctccgacgacaccgccacctacttctgcgcccgcctcgaggccgacggctccgactactcccccaagatgttcgacttctggggccagggcaccaagatcgtcgtctcccccgcctccaccaagggc

SEQ ID NO: 19695 - RNA, 387 nt, synthetic construct
  misc_feature 1..387: note = derived and/or modified sequence opt2 from anti-HIV_Chain
  source 1..387: mol_type = other RNA
caggtccgcctcgtccagtccggcccccaggtcaagacccccggcgcctccatgcgcgtctcctgcgaggcctccggctaccgcttcctcgactacatcatcgtctggatccgccagacccacggccagcacttcgagtacgtcggcatgatcaacccccgcggcggcaccccctggccctcctccaagttccgcgaccgcctctccctcacccgcgacatccacaccgacaccttctacctcggcctcaacaacctcggctccgacgacaccgccatctacttctgcgcccgcctcgaggccgacggcgacgactactcccccaagatgttcgaccactggggccagggcacccgcatcatcgtctccgccgcctccaccaagggc

SEQ ID NO: 19696 - RNA, 387 nt, synthetic construct
  misc_feature 1..387: note = derived and/or modified sequence opt2 from anti-HIV_Chain
  source 1..387: mol_type = other RNA
caggtccgcctcgtccagtccggcccccaggtcaagacccccggcgcctccatccgcctctcctgcgaggcctccggctaccgcttcctcgactacttcatcgtctgggtccgccagacccccggccagggcttcgagtacgtcggcatgatcaacccccgcggcggccgcccctggtcctcctggaagttccgcgaccgcctctccctcacccgcgagatcgacaccgacaccttctacctcggcctctccaacctccgctccgacgacaccgccatctacttctgcgcccgcctcgaggccgacggcgacgactactcccccaagatggtcgactactggggccagggcaccaagatcatcgtctccgccgcctccaccaagggc

SEQ ID NO: 19697 - RNA, 387 nt, synthetic construct
  misc_feature 1..387: note = derived and/or modified sequence opt2 from anti-HIV_Chain
  source 1..387: mol_type = other RNA
caggtccgcctcgtccagtccggcccccaggtcaagcgccccggcgcctccatccgcctctcctgcgagacctccggctaccgcttccaggactacatcgtcgcctggatccgccagacccgcggccagcgcttcgagttcgtcggcatggtcaacccccgcggcggccgcccctggccctcctccaagttccgcgaccgcgtcaccctcacccgcgacatcgagtccgagaccttccacctcggcctcaacgacctcacctccgacgacaccgccacctacttctgcgcccgcctcgaggccgacggcgccgactactcccccaagatgttcgacttctggggccagggcaccaagatcgtcgtctcccccgcctccaccaagggc

SEQ ID NO: 19698 - RNA, 387 nt, synthetic construct
  misc_feature 1..387: note = derived and/or modified sequence opt2 from anti-HIV_Chain
  source 1..387: mol_type = other RNA
caggtccgcctcgtccagtccggcccccaggtcaagacccccggcgcctccatgcgcatctcctgcgaggcctccggctaccgcttccaggactacatcatcgtctggatccgccagacccacggccagggcttcgagtacgtcggcatgatcaacccccgcggcggcaccccctggtcctcctccaagttccgcgaccgcctctccctcacccgcgacatctacaccgacaccttctacctcggcctcaacaacctcggctccgacgacaccgccatctacttctgcgcccgcctcgaggccgacggcggcgactactcccccaagatgttcgactactggggccagggcacccgcatcatcgtctccgccgcctccaccaagggc

SEQ ID NO: 19699 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagcccggcgcctccgtcaccatctcctgcctcgcctccgagtacaccttcaacgagttcgtcatccactggatccgccaggcccccggccagggccccctctggctcggcctcatcaagcgctccggccgcctcatgaccgcctacaagttccaggaccgcctctccctccgccgcgaccgctccaccggcaccgtcttcatggagctccgcggcctccgccccgaggacaccgccgtctactactgcgcccgcgacggcctcggcgaggtcgcccccgactaccgctacggcatcgacgtctggggccagggctccaccgtcatcgtctccgccgcctccaccaagggc

SEQ ID NO: 19700 - RNA, 387 nt, synthetic construct
  misc_feature 1..387: note = derived and/or modified sequence opt2 from anti-HIV_Chain
  source 1..387: mol_type = other RNA
caggtccgcctcgtccagtccggcccccagatgaagacccccggcgcctccctccgcctctcctgcgaggtctccggctaccgcttcctcgactacttcatcgtctgggtccgccagaccggcggccagggcttcgagtacgtcggcatgatcaacccccgcggcggccgcccctggtcctcctggaagttccgcgaccgcctctccctcacccgcgacatcgagaccgacaccttctacctcggcctcaacaacctccgctccgacgacaccgccatctacttctgcgcccgcctcgaggccgacggcgacaactactcccccaagatggtcgactactggggccagggcaccaagatcatcgtctcccccgcctccaccaagggc

SEQ ID NO: 19701 - RNA, 387 nt, synthetic construct
  misc_feature 1..387: note = derived and/or modified sequence opt2 from anti-HIV_Chain
  source 1..387: mol_type = other RNA
caggtctccctcgtccagtccggcccccaggtcaagacccccggcgcctccatgcgcgtctcctgcgagacctccggctaccgcttcctcgactacatcatcgtctggatccgccagacccacggccagcacttcgagtacgtcggcatgatcaacccccgcggcggcaccccctggccctcctccaagttccgcgaccgcctcaccatgacccgcgacatccacaccgacaccttctacctcggcctcaacaacctccgctccgacgacaccgccatctacttctgcgcccgcctcgaggccgacggcgacgactactcccccaagatgttcgactactggggccagggcacccgcatcatcgtctccgccgcctccaccaagggc

SEQ ID NO: 19702 - RNA, 387 nt, synthetic construct
  misc_feature 1..387: note = derived and/or modified sequence opt2 from anti-HIV_Chain
  source 1..387: mol_type = other RNA
caggtccgcctcgtccagtccggcccccaggtcaagaccgccggcgcctccatgcgcgtctcctgcgaggcctccggctaccgcttcctcgactacatcatcgtctggatccgccagacccacggccagcacttcgagtacgtcggcatgatcaacccccgcggcggcaccccctggccctcctccaagttccgcgaccgcctcaccctcacccgcgacatctacaccgacaccttctacctcggcctcaacaacctcggctccggcgacaccgccatctacttctgcgcccgcctcgaggccgacggcgacgactactcccccaagatgttcgactactggggccagggcacccgcatcatcgtctccgccgcctccaccaagggc

SEQ ID NO: 19703 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagcccggcacctccgtcaccatctcctgcctcgcctccgagtacaccttcaacgagttcgtcatccactggatccgccaggcccccggccagggccccgtctggctcggcctcatcaagcgctccggccgcctcatgacctcctacaagttccaggaccgcctctccctccgccgcgaccgctccaccggcaccgtcttcatggagctccgcggcctccgcctcgacgacaccgccgtctactactgcgcccgcgacggcctcggcgaggtcgcccccgcctacctctacggcatcgacgcctggggccagggctccaccgtcatcgtcacctccgcctccaccaagggc

SEQ ID NO: 19704 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcctcaagaagcccggcacctccgtcaccatctcctgcctcgcctccgagtacaccttcaacgagttcgtcatccactggatccgccaggcccccggccagggccccctctggctcggcctcatcaagcgctccggccgcctcatgaccgcctacaacttccaggaccgcctccgcctccgccgcgaccgctccaccggcaccgtcttcatggagctccgcggcctccgccccgacgacaccgccgtctactactgcgcccgcgacggcctcggcgaggtcgcccccgactaccgctacggcatcgacgtctggggccagggctccaccgtcatcgtcaccgccgcctccaccaagggc

SEQ ID NO: 19705 - RNA, 387 nt, synthetic construct
  misc_feature 1..387: note = derived and/or modified sequence opt2 from anti-HIV_Chain
  source 1..387: mol_type = other RNA
cagggccacctcgtccagtccggcggcggcgtcaagaagctcggcacctccgtcaccatctcctgcctcgtctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccaccaagggc

SEQ ID NO: 19706 - RNA, 387 nt, synthetic construct
  misc_feature 1..387: note = derived and/or modified sequence opt2 from anti-HIV_Chain
  source 1..387: mol_type = other RNA
cagggccagctcgtccagtccggcggcggcgtcaagaagctcggcacctccgtcaccatctcctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtctcctccgcctccaccaagggc

SEQ ID NO: 19707 - RNA, 387 nt, synthetic construct
  misc_feature 1..387: note = derived and/or modified sequence opt2 from anti-HIV_Chain
  source 1..387: mol_type = other RNA
cagggccacctcgtccagtccggcggcggcgtcaagaagctcggcacctccgtcaccatctcctgcctcgcctccgagtacaccttcaacgagttcgtcatccactggatccgccaggcccccggccagggccccctctggctcggcctcatcaagcgctccggccgcctcatgacctcctaccagttccaggaccgcctctccctccgccgcgaccgctccaccggcaccgtcttcatggagctccgcggcctccgcgtcgacgacaccgccgtctactactgcgcccgcgacggcctcggcgaggtcgcccccgcctacctctacggcatcgacgcctggggccagggcaccaccgtcatcgtcacctccgcctccaccaagggc

SEQ ID NO: 19708 - RNA, 387 nt, synthetic construct
  misc_feature 1..387: note = derived and/or modified sequence opt2 from anti-HIV_Chain
  source 1..387: mol_type = other RNA
caggtccagctcgtccagtccggctccgagctcaagaagcccggcgcctccgtcaaggtctcctgcaaggcctccggctacaccttcacctcctacgccatcaactgggtccgccaggcccccggccagggcctcgagtggatgggctggatcaacaccaacaccggcaaccccacctacgcccagggcttcaccggccgcttcgtcttctccctcgagacctccgtctccaccgcctacctccagatcaactccctcaaggccgaggacaccgccgtctactactgcgcccgcgacctcctcgagtcccgcacctactacaacgacatccgcgactgctggggccagggcaccctcgtcaccgtctcctccgcctccaccaagggc

SEQ ID NO: 19709 - RNA, 387 nt, synthetic construct
  misc_feature 1..387: note = derived and/or modified sequence opt2 from anti-HIV_Chain
  source 1..387: mol_type = other RNA
caggtccagctcgtccagtccggcgccgaggtcaagaagcccggcgcctccgtcaaggtctcctgcaaggcctccggctacaccttcaccgactactacatccactgggtccgccaggcccccggccagggcctcgagtggatgggctggatcaacccctccaccggcggcaccaacttcgtccagaagttcctcggccgcgtcaccatgacctccgacacctccatcaacaccgcctacatggagctccgccgcctcaagaacgacgacgccgccatctactactgcgccacctactccacccgccagttcttccactactactacgtcaccgacgtctggggccagggcaccaccgtcaccgtctcctccgcctccaccaagggc

SEQ ID NO: 19710 - RNA, 387 nt, synthetic construct
  misc_feature 1..387: note = derived and/or modified sequence opt2 from anti-HIV_Chain
  source 1..387: mol_type = other RNA
ttccagggccagctcgtccagtccggcggcggcgtcaagaagcccggctcctccgtcaccatctcctgcctcgcctccgagtacaccttcaccgagttcaccatccactggatccgccaggcccccggccagggccccctctggctcggcctcatcaagcgctccggccgcctcatgacctcctacggcttccaggaccgcctctccgtccgccgcgaccgctccaccggcaccgtcttcatggagctccgctccctccgcaccgacgacaccgccgtctactactgcgcccgcgacggcctcggcgagctcgcccccgcctaccactacggcatcgacgtctggggccagggcaccaccgtcatcgtcacctccgcctccacctcc

SEQ ID NO: 19711 - RNA, 387 nt, synthetic construct
  misc_feature 1..387: note = derived and/or modified sequence opt2 from anti-HIV_Chain
  source 1..387: mol_type = other RNA
caggtccagctcgtcgagtccggcggcggcgtcgtccagcccggccgctccctccgcctctcctgcgccgcctccggcttcaccttctcctcctacgccatgcactgggtccgccaggcccccggcaagggcctcgagtgggtcgccgtcatctcctacgacggctccaacaagtactacgccgactccgtcaagggccgcttcaccatctcccgcgacgactccaagtccaccgtctacctccagatcaactccctccgcgccgccgacaccgccgtctacttctgcgcccgcgagggcggcctccgcttcctcgagtggctcttctggggccagggcaccctcgtcaccgtctcctccggcgagtcctccgcctccaccaagggc

SEQ ID NO: 19712 - RNA, 390 nt, synthetic construct
  misc_feature 1..390: note = derived and/or modified sequence opt2 from anti-HIV_Chain
  source 1..390: mol_type = other RNA
caggtccagctcgtccagtccggcgccgtcgtcaagtcccccggctcctccgccaagctctcctgccgcctcctcggcgacgagttcggcacctacttcatctcctggatccgccaggcccccggccgcggcctcgagtgggtcggcggcatcgtcccccactcccagctccagtcctccgcccagaagttccacggccgcttcttcatcaccggcggcgtcaccccccccatcatcttcctccagctcaccaacgtcaccttcgaggacaccggcacctacttctgcgcccgcgagcgcggccgccaccgcgaccccaagaccggcaagtccctccgcggccgctacttcgacttctggggccgcggcaccggcgtcaccgtctccccc

SEQ ID NO: 19713 - RNA, 390 nt, synthetic construct
  misc_feature 1..390: note = derived and/or modified sequence opt2 from anti-HIV_Chain
  source 1..390: mol_type = other RNA
cagatcgagctccgccagtccggcgccgccatgaagtcccccggctcctccgtcaagctctcctgcaccgtcctcggcgagaacttcggcacctacttcatctcctggatccgccaggcccccggccagggcctcgagtgggtcggcggcatcgtcccccactcccagctccagtcctccgcccagaagttccacggccgcatcaagatctccggcggcggcaccccccccgtcgtctccctcgagctcaccaacgtcaccttcgacgacaccggcacctacttctgcgcccgcgagcgcggccgccacgtcgagcccaagaccggcgaccgcctcgccggccgctacttcgacatctggggccgcggcaccggcctccgcgtctccccc

SEQ ID NO: 19714 - RNA, 390 nt, synthetic construct
  misc_feature 1..390: note = derived and/or modified sequence opt2 from anti-HIV_Chain
  source 1..390: mol_type = other RNA
gaggtccagctcgtcgagtccggcggcggcctcgtcaagcccggcggctccctccgcctctcctgcgaggcctccggcttcaccttcaccaacgcctggatgaactgggtccgccaggcccccggcaagggcctcgagtgggtcggccgcatcaagtcccagacccacggcggcaccacccgctacgccgcccccgtcaagggccgcttcaccatctcccgcgacgactccaagcacaccctctacctccagatggaccgcctcaccaccgaggacaccgccgtctactactgcaccggcaccatcaccggctccaccttctactactacggcatggacgtctggggccagggcaccaccgtcaccgtctcccccgcctccaccaagggc

SEQ ID NO: 19715 - RNA, 390 nt, synthetic construct
  misc_feature 1..390: note = derived and/or modified sequence opt2 from anti-HIV_Chain
  source 1..390: mol_type = other RNA
gtcgtccagctcgtccagtccggccccggcctcgtcaagccctcccagaccctctccctcacctgcaccgtctccggcggctccatctcctccggcgacttctactggtcctggatccgccagccccccggcaagggcctcgagtggatcggctacatctactactccggctccacctactacaacccctccctcaagtcccgcctcaccatctccgtcgacacctccaagaaccagttctccctccgcctctcctccgtcaccgccgccgacaccgccgtctactactgcgcccgcgacctcaactcccgcatcgtcggcgccctcgacgccttcgacatctggggccagggcaccatggtcaccgtctcctccgcctccaccaagggc

SEQ ID NO: 19716 - RNA, 390 nt, synthetic construct
  misc_feature 1..390: note = derived and/or modified sequence opt2 from anti-HIV_Chain
  source 1..390: mol_type = other RNA
gaggtccagctcgtccagtccggcggcggcctcgtccagcccggccgctccctccgcctctcctgcgccgcctccggcttcaccttcgacgactacgccatgcactgggtccgccaggcccccggcaagggcctcgagtgggtctccggcatctcctggaactccggcaccatcggctacgccgactccgtccgcggccgcttcaccatctcccgcgacgacgccaagtcctccctctacctccagatgaactccctccgcaccgaggacaccgccctctactactgcgccaaggacggctgggtcggctccggctcctccaccctccgcggctccgactactggggccagggcaccctcgtcaccgtctcctccgcctccaccaagggc

SEQ ID NO: 19717 - RNA, 390 nt, synthetic construct
  misc_feature 1..390: note = derived and/or modified sequence opt2 from anti-HIV_Chain
  source 1..390: mol_type = other RNA
cagtccgtcctcacccagcccccctccgcctccggctcccccggccagtccatcaccatctcctgcaccggcacctcctccgacgtcggcggctacaactacgtctcctggtaccagcagccccccggcaaggcccccaaggtcatcatctacgaggtctccaagcgcccctccggcgtccccgaccgcttctccggctccaagtccggcaacaccgcctccctcaccgtctccggcctccaggccgaggacgaggccgactactactgctcctcctacgccggctccaacaacttcgtcttcggcaccggcaccgaggtcaccgtcgtcggccagcccaaggccaaccccaccgtcaccctcttccccccctcctccgaggagctcctc

SEQ ID NO: 19718 - RNA, 390 nt, synthetic construct
  misc_feature 1..390: note = derived and/or modified sequence opt2 from anti-HIV_Chain
  source 1..390: mol_type = other RNA
caggccgtcgtcacccaggagccctccctcaccgtctcccccggcggcaccgtcaccctcacctgcgcctcctccaccggcgccgtcacctccggcttctacccccactggttccagcagaagcccggccaggccccccgcgccctcatctactccacctccaaccgctactcctggacccccgcccgcttctccggctccctcctcggcggcaaggccgccctcaccctctccggcgtccagcccgaggacgaggccgagtactactgcctcctcctcccctactacggcggcccctggatcttcggcggcggcaccaagctcaccgtcctcggccagcccaaggccgccccctccgtcaccctcttccccccctcctccgaggagctc

SEQ ID NO: 19719 - RNA, 390 nt, synthetic construct
  misc_feature 1..390: note = derived and/or modified sequence opt2 from anti-HIV_Chain
  source 1..390: mol_type = other RNA
cagtccgccctcacccagcccccctccgcctccggcgcccccggccagcgcgtcaccatctcctgctccggcggcccctccaacgtcggcggcaactacgtctactggtaccgccagttccccggcaccgcccccaccctcctcatcctccgcgacgaccagcgcccctccggcgtccccgaccgcttctccgcctccaagtccggcaactccgcctccctcgccatctccggcctccgccccgacgacgagggcttctacttctgcgccacctacgactccgacggctccatccgcctcttcggcggcggcaccgccctcaccgtcctctcccagcccaaggccgccccctccgtcaccctcttccccccctcctccgaggagctcaag

SEQ ID NO: 19720 - RNA, 390 nt, synthetic construct
  misc_feature 1..390: note = derived and/or modified sequence opt2 from anti-HIV_Chain
  source 1..390: mol_type = other RNA
caggtccagctcgtcgagtccggctccgacgtccgcaagcccggcgccaccgtcaccgtctcctgcaaggccgacgaggacgaggacgacttcaccgcctacaactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctccgcctccaccaagggc

SEQ ID NO: 19721 - RNA, 390 nt, synthetic construct
  misc_feature 1..390: note = derived and/or modified sequence opt2 from anti-HIV_Chain
  source 1..390: mol_type = other RNA
gaggtccagctcgtcgagtccggctccgacgtccgcaagcccggcgccaccgtcaccgtctcctgcaaggccgacgaggacgaggacgacttcaccgcctacaactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctccgcctccaccaagggc

SEQ ID NO: 19722 - RNA, 390 nt, synthetic construct
  misc_feature 1..390: note = derived and/or modified sequence opt2 from anti-HIV_Chain
  source 1..390: mol_type = other RNA
gaggtccagctcgtccagtccggctccgacgtccgcaagcccggcgccaccgtcaccgtctcctgcaaggccgacgaggacgaggacgacttcaccgcctacgactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctccgcctccaccaagggc

SEQ ID NO: 19723 - RNA, 390 nt, synthetic construct
  misc_feature 1..390: note = derived and/or modified sequence opt2 from anti-HIV_Chain
  source 1..390: mol_type = other RNA
caggtccagctcgtccagtccggctccgacgtccgcaagcccggcgccaccgtcaccgtctcctgcaaggccgacgaggacgaggacgacttcaccgcctacaactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctccgcctccaccaagggc

SEQ ID NO: 19724 - RNA, 390 nt, synthetic construct
  misc_feature 1..390: note = derived and/or modified sequence opt2 from anti-HIV_Chain
  source 1..390: mol_type = other RNA
caggtccagctcgtccagtccggctccgacgtccgcaagcccggcgccaccgtcaccgtctcctgcaaggccgacgaggacgaggacgacttcaccgcctacaactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcccgcggccgcggcacctccctcaccgtctcctccgcctccaccaagggc

SEQ ID NO: 19725 - RNA, 390 nt, synthetic construct
  misc_feature 1..390: note = derived and/or modified sequence opt2 from anti-HIV_Chain
  source 1..390: mol_type = other RNA
gaggtccagctcgtcgagtccggctccgacgtccgcaagcccggcgccaccgtcaccgtctcctgcaaggccgacgaggacgaggacgacttcaccgcctacaactacttcatgcactgggtccgccaggcccccggccagggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctccgcctccaccaagggc

SEQ ID NO: 19726 - RNA, 390 nt, synthetic construct
  misc_feature 1..390: note = derived and/or modified sequence opt2 from anti-HIV_Chain
  source 1..390: mol_type = other RNA
gtcgtccagctcgtccagtccggctccgacgtccgcaagcccggcgccaccgtcaccgtctcctgcaaggccgacgaggacgaggacgacttcaccgcctacaactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctccgcctccaccaagggc

SEQ ID NO: 19727 - RNA, 390 nt, synthetic construct
  misc_feature 1..390: note = derived and/or modified sequence opt2 from anti-HIV_Chain
  source 1..390: mol_type = other RNA
gaggtccagctcgtccagtccggctccgacgtccgcaagcccggcgccaccgtcaccgtctcctgcaaggccgacgaggacgaggacgacttcaccgcctacaactacttcatgcactgggtccgccaggcccccggccacggcctcgagtggatcggctggatcaacccccgcaccggccagcccaaccacgccaagcagttccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcaccgtctcctccgcctccaccaagggc

SEQ ID NO: 19728 - RNA, 390 nt, synthetic construct
  misc_feature 1..390: note = derived and/or modified sequence opt2 from anti-HIV_Chain
  source 1..390: mol_type = other RNA
gaggtccagctcgtccagtccggctccgacgtcaagaagcccggcaccaccgtcaccatctcctgcaaggccgacgaggacgaggacgacttcaccgcctacaactacttcatgcactgggtccgccaggcccccggccagggcctcgagtggatcggctggatcaacccccgcaccggccagcccaaccacgccaagcagctccagggccgcgtcaccctcacccgcgagcgctccacctccaccgtcttcatgaagctcaccaacctccgcctcgacgacaccgccgtctacttctgcgcccgccccctccgcggcggcgacacctggcactaccactcctggggccgcggcacctccctcatcgtctcctccgcctccaccaagggc

SEQ ID NO: 19729 - RNA, 390 nt, synthetic construct
  misc_feature 1..390: note = derived and/or modified sequence opt2 from anti-HIV_Chain
  source 1..390: mol_type = other RNA
caggtccagctcgtcgagtccggcggcggcctcgtcaagcccggcggctccctccgcctctcctgcgccgcctccggcttctccttcaacgagtactacatgtcctggatccgccaggcccccggccagggcctcgagtgggtcgccaacatcggctcctccgacgcctacaccatctacgccgactccgtcaagggccgcttcaccatctcccgcgacaacgccgagaacaccgtctacctccagatgaactccctccgcggcgaggacaccgccgtctactactgcgcccgcatcgagggctactgctccaactcccgctgctccaactacttcgacccctggggccagggcgccctcgtcaccgtctcctccgcctccaccaagggc

SEQ ID NO: 19730 - RNA, 390 nt, synthetic construct
  misc_feature 1..390: note = derived and/or modified sequence opt2 from anti-HIV_Chain
  source 1..390: mol_type = other RNA
caggtccagctcgtccagtccggcgccgaggtcaagaagcccggcgcctccgtcaaggtctcctgcaaggtctccggctaccccctcgccgagctctccgtccactgggtccgccaggtccccggcaagggcctcgagtgggtcggcggcttcgaccccgaggagggcaagaccgtctacgcccagaagttccagggccgcgtcaccatgaccgaggaccgctccaccgacaccgtctacatggagctcatctccctccgctacgaggacaccgccgtctactactgcgccaccgacaaccccgtcctccagctcggcgagctctcctcctccctcgactactggggccagggcaccctcgtcaccgtctcctccgcctccaccaagggc

SEQ ID NO: 19731 - RNA, 390 nt, synthetic construct
  misc_feature 1..390: note = derived and/or modified sequence opt2 from anti-HIV_Chain
  source 1..390: mol_type = other RNA
gaggtccagctcgtccagtccggcgccgaggtcaagaagcccggcgagtccctccgcatctcctgcaagacctccggctacaacttcaacgacgactggatcgcctgggtccgccagcgccccgacaagggccccgagtggatgggcatcttctaccccggcgactcccaggccacctactccccctccttccagggccacgtcaccttctccgccgacacctccatctccaccgcctacctccagtggacctccctcaaggcctccgacaccgccatctactactgcgcccgcacccgctgcttcggcgccaactgcttcaacttcatggacgtctggggcaagggcaccgccctcaccgtcaccgtctcctccgcctccaccaagggc

SEQ ID NO: 19732 - RNA, 390 nt, synthetic construct
  misc_feature 1..390: note = derived and/or modified sequence opt2 from anti-HIV_Chain
  source 1..390: mol_type = other RNA
caggtccagctcgtccagctcctccagtccggcgccgaggtcaagaagcccggctcctccgtcaaggtctcctgccagatctccggctacggcttctccaactacgccatctcctgggtccgccaggcccccggccagggcctcgagtggctcggccgcatcgtccccgccgtcggcatgaccgagtacgcccagaagttccagggccgcgtcaccttcaccgccgaccgctccaccatcaccgcctacatggacctccgcggcctccgctccgacgacaccgccgtctactactgcgtccgcgacccccaggtcgaggtccgcggcaacgccttcgacatctggggccagggcaccatggtcaccgtctcctccgcctccaccaagggc

SEQ ID NO: 19733 - RNA, 390 nt, synthetic construct
  misc_feature 1..390: note = derived and/or modified sequence opt2 from anti-HIV_Chain
  source 1..390: mol_type = other RNA
caggtccacctccagcagtggggcgccggcctcctcaagccctccgagaccctctccctcacctgcgccgtctccggcggctccttctccggcttcttctggacctggatccgccagtcccccggcaagggcctcgagtggatcggcgaggtcaaccactccggcttcacccactccaacccctccctcgagtcccgcgccaccatctccgtcgccgcctccaacacccagttctccctccgcctcgcctccgtcaccgccgccgacaccgccatctacttctgcgccctccgctacttcgactggtcccccttccgccgcgacacctacggcaccgacgtctggggccagggcaccaccgtcatcgtctcctccgcctccaccaagggc

SEQ ID NO: 19734 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcggcgccctccgcaagcccggcgcctccgtcaccctctcctgccaggcctccggctacaacttcgtcaagtacatcatccactgggtccgccagcgccccggcctcggcttcgagtgggtcggcatgatcgacccctaccgcggccgcccctggtacgcccactccttcgccggccgcctctccctctcccgcgacacctccaccgagaccctctacatgaccctctcctccctcaagtccgacgacaccgccacctacttctgcgcccgcgccgaggccgcctccgactcccactcccgccccatcatggactggacctggcgcatcctctgcctcctcgccgtcgtccccgcctccaccaagggc

SEQ ID NO: 19735 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccgtccgcaagcccggcgcctccgtcaccctctcctgccaggcctccggctacaacttcgtcaactacatcatccactgggtccgccagcgccccggcctcgacttcgagtgggtcggcatgatcgacccctaccgcggccgcccctggtccgcccacaagttccagggccgcctctccctctcccgcgacgtctccaccgagatcctctacatgaccctcaactccctccgctccgacgacaccgccacctacttctgcgcccgcgccgaggccgagtcccagtcccactcccgccccatcatgttcgactcctggggccagggctcccgcgtcaccgtctcctccgcctccaccaagggc

SEQ ID NO: 19736 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccgtcaagaagcccggcgcctccgtcaccatctcctgccaggcctccggctacaacttcgtcaagttcttcatccactgggtccgccagcgccccggccagggcttcgagtgggtcggcatgatcgagccctaccgcggccgcccctggtccgccggcaacttccagggccgcctctccctctcccgcgacgtctccaccgagaccctctacatgaccctcaacaacctccgctccgacgacaccgccgtctacttctgcgcccgcctcgaggccgagtccgactcccactcccgccccatcatgttcgaccactggggccacggctccctcgtcaccgtctcctccgcctccaccaagggc

SEQ ID NO: 19737 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccgtccgcaagcccggcgcctccgtcaccctctcctgccaggcctccggctacaacttcgtcaactacatcatccactgggtccgccagcgccccggcctcgacttcgagtgggtcggcatgatcgacccctaccgcggccgcccctggtccgcccacaagttcgagggccgcctctccctctcccgcgacgtctccaccgaggtcctctacatgaccctctcctccctccgctccgacgacaccgccacctacttctgcgcccgcgccgaggccgagtcccagtcccactcccgccccatcatgttcgactactggggccagggctcccgcgtcaccgtctcctccgcctccaccaagggc

SEQ ID NO: 19738 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcaccgccgtccgcaagcccggcgcctccgtcaccatctcctgccaggcctccggctacaacttcgtcaagttcttcatccacggcgtccgccagcgccccggccagggcttcgagtgggtcggcatgatcgagcccttccgcggccgcccctggtccgccggcaacttccagggccgcctctccctctcccgcgacgtctccaccgagaccctctacatgaccctcaacaacctccgctccgacgacaccgccgtctacttctgcgcccgcctcgaggccgagtccgactcccactcccgccccatcatgttcgaccactggggccacggctccctcgtcaccgtctcctccgcctccaccaagggc

SEQ ID NO: 19739 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcaccgccatgcgcaagcccggcgcctccgtcaccctctcctgccaggcctccggctacaacttcgtcaagtacatcgtccactgggtccgccagaagcccggcctcggcttcgagtgggtcggcatgatcgacccctaccgcggccgcccctggtccgcccacaagttccagggccgcctctccctctcccgcgacacctccatggagatcctctacatgaccctcacctccctcaagtccgacgacaccgccacctacttctgcgcccgcgccgaggccgcctccgactcccactcccgccccatcatgttcgaccactggggccagggctcccgcgtcaccgtctcctccgcctccaccaagggc

SEQ ID NO: 19740 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccatgcgcaagcccggcgcctccgtcaccctctcctgccaggcctccggctacaacttcgtcaagtacatcgtccactgggtccgccagaagcccggcctcggcttcgagtgggtcggcatgatcgacccctaccgcggccgcccctggtccgcccacaagttccagggccgcctctccctctcccgcgacacctccatggagatcctctacatgaccctcacctccctcaagtccgacgacaccgccacctacttctgcgcccgcgccgaggccgcctccgactcccactcccgccccatcatgttcgaccactggggccagggctcccgcgtcaccgtctcctccgcctccaccaagggc

SEQ ID NO: 19741 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccatgcgcaagcccggcgcctccgtcaccctctcctgccaggcctccggctacaacttcgtcaagtacatcatccactgggtccgccagaagcccggcctcggcttcgagtgggtcggcatgatcgacccctaccgcggccgcccctggtccgcccacaagttccagggccgcctctccctctcccgcgacacctccatggagatcctctacatgaccctcacctccctcaagtccgacgacaccgccacctacttctgcgcccgcgccgaggccgcctccgactcccactcccgccccatcatgttcgaccactggggccagggctcccgcgtcaccgtctcctccgcctccaccaagggc

SEQ ID NO: 19742 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcaacgccgtccgcaagcccggcgcctccgtcaccatctcctgccaggcctccggctacaacttcgtcaagttcttcatccactgggtccgccagcgccccggccagggcttcgagtgggtcggcatgatcgagcccttccgcggccgcccctggtccgccggcaacttccagggccgcctctccctctcccgcgacgtctccaccgagaccctctacatgaccctcaacaacctccgctccgacgacaccgccgtctacttctgcgcccgcctcgaggccgagtccgactcccactcccgccccatcatgttcgaccactggggccacggctccctcgtcaccgtctcctccgcctccaccaagggc

SEQ ID NO: 19743 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccgtccgcaagcccggcgcctccgtcaccctctcctgccaggcctccggctacaacttcgtccgctacatcatccactgggtccgccagcgccccggcctcgacttcgagtgggtcggcatgatcgacccctaccgcggccgcccctggtccgcccacaagttcggcggccgcctctccctcacccgcgacgtctccaccgagatcctctacatgaccctcacctccctccgctccgacgacaccgccacctacttctgcgcccgcgccgaggccgagtcccagtcccactcccgccccatcatgttcgactcctggggccagggctcccgcgtcaccgtctcctccgcctccaccaagggc

SEQ ID NO: 19744 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccgtccgcaagcccggcgcctccgtcaccctctcctgccaggcctccggctacaacttcgtcaactacatcatccactgggtccgccagcgccccggcctcgacttcgagtgggtcggcatgatcgacccctaccgcggccgcccctggtccgcccacaagttccagggccgcctctccctctcccgcgacgtctccaccgagatcctctacatgaccctctcctccctccgctccgacgacaccgccacctacttctgcgcccgcgccgaggccgagtcccagtcccactcccgccccatcatgttcgacttctggggccagggctcccgcgtcaccgtctcctccgcctccaccaagggc

SEQ ID NO: 19745 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcaccgccgtccgcaagcccggcgcctccgtcaccatctcctgccaggcctccggctacaacttcgtcaagttcttcatccactgggtccgccagcgccccggccagggcttcgagtgggtcggcatgatcgagcccttccgcggccgcccctggtccgccggcaacttccagggccgcctctccctctcccgcgacgtctccaccgagaccctctacatgaccctcaacaacctccgctccgacgacaccgccgtctacttctgcgcccgcctcgaggccgagtccgactcccactcccgccccatcatgttcgaccactggggccacggctccctcgtcaccgtctcctccgcctccaccaagggc

SEQ ID NO: 19746 - RNA, 390 nt, synthetic construct
  misc_feature 1..390: note = derived and/or modified sequence opt2 from anti-HIV_Chain
  source 1..390: mol_type = other RNA
caggtccgcctcgagcagtccggcgccgccatgcgcaagcccggcgcctccgtcaccctctcctgccaggcctccggctacaacttcgtcaagtacatcgtccactgggtccgccagaagcccggcctcggcttcgagtgggtcggcatgatcgacccctaccgcggccgcccctggtccgcccacaagttccagggccgcctctccctctcccgcgacacctccatggagatcctctacatgaccctcacctccctcacctccgacgacaccgccacctacttctgcgcccgcgccgaggccgcctccgactcccactcccgccccatcatgttcgaccactggggccagggctcccgcgtcaccgtctcctccgcctccaccaagggc

SEQ ID NO: 19747 - RNA, 390 nt, synthetic construct
  misc_feature 1..390: note = derived and/or modified sequence opt2 from anti-HIV_Chain
  source 1..390: mol_type = other RNA
gaggtccagctcgtccagtccggcggcggcctcgtccagcccggcggctccctccgcctctcctgcgccgcctccggcctcaccttccgcaacttcgccatgtcctgggtccgccaggcccccggcaagggcctcgagtgggtctcctccatctccggctccggcggctccacctactacgccgactccgtcaagggccgcttcaccatctcccgcgacaactccaagaacaccctctacctccagatgaactccctccgcggcgaggacaccgccgtctacttctgcgccaagggcgtcggctacgacatcctcaccggcctcggcgacgccttcgacatctggggccagggcaccgtcgtcgccgtctcctccgcctccaccaagggc

SEQ ID NO: 19748 - RNA, 393 nt, synthetic construct
  misc_feature 1..393: note = derived and/or modified sequence opt2 from anti-HIV_Chain
  source 1..393: mol_type = other RNA
caggtccagctcgtccagtccggcgccgccgtccgcaagcccggcgcctccgtcaccgtctcctgcaagttcgccgaggacgacgactactccccccactgggtcaaccccgcccccgagcactacatccacttcctccgccaggcccccggccagcagctcgagtggctcgcctggatgaaccccaccaacggcgccgtcaactacgcctggcagctccacggccgcctcaccgccacccgcgacggctccatgaccaccgccttcctcgaggtccgctccctccgctccgacgacaccgccgtctactactgcgcccgcgcccagaagcgcggccgctccgagtgggcctacgcccactggggccagggcacccccgtcctcgtctcctcc

SEQ ID NO: 19749 - RNA, 393 nt, synthetic construct
  misc_feature 1..393: note = derived and/or modified sequence opt2 from anti-HIV_Chain
  source 1..393: mol_type = other RNA
caggtccagctccagcagtggggcgccggcctcctcaagccctccgagaccctctccctcacctgcgccgtctacgccggctccttctccggctactactggacctggatccgccagccccccggcaagggcctcgagtggatcggcgaggtcaaccacggcggctccaccaactacaacccctccctcaagtcccgcgtcaccctctccgtcgacacctccaagaaccagttctccctcaagctcacctccgtcaccgccgccgacaccgccgtctactactgcgcccgcgtctcccgctacgacttctggtccggcaactacggctcctacggcctcgacgtctggggccagggcaccaccgtcaccgtctcctccgcctccaccaagggc

SEQ ID NO: 19750 - RNA, 393 nt, synthetic construct
  misc_feature 1..393: note = derived and/or modified sequence opt2 from anti-HIV_Chain
  source 1..393: mol_type = other RNA
gaggtccagctcgtccagtccggcggcggcgtcgtccagcccggccgctccctccgcctctcctgcgtcgtctccggcttcaccttctcctccttcaccttccactgggtccgccaggcccccggcaagggcctcgagtgggtcgccggcatgtccttccacgccacctacatctactacgccgactccgtcaagggccgcttcaccatctcccgcgacgactcccaggacaccctctacctcgagatggactccctccgctccgaggacaccgccatctactactgcgcccgcgaccccggcatccacgactacggcgactacgcccccggcgccttcgactactggggccagggctcccccgtcaccgtctcctccgcctccaccaagggc

SEQ ID NO: 19751 - RNA, 393 nt, synthetic construct
  misc_feature 1..393: note = derived and/or modified sequence opt2 from anti-HIV_Chain
  source 1..393: mol_type = other RNA
caggtccagctcgtccagtccggcaccgaggtccagaagcccggcgcctccgtcaaggtctcctgcaagacctccggctacaccttctccaagtactacatccactgggtccgccaggcccccggccagggcctcgagtgggtcggccgcatcaacaccgactccggcggcaccgactacgccgagaagttccagggccgcgtcaccatgacccgcgacacctccatcaccaccgtctacctcgagatgcgcggcctcacctccgacgacaccgccgccttctactgcgcccgcggccccccccacgccggcggctggaccatctactactacggcctcgacgtctggggccagggcacctccgtcatcgtctcctccgcctccaccaagggc

SEQ ID NO: 19752 - RNA, 393 nt, synthetic construct
  misc_feature 1..393: note = derived and/or modified sequence opt2 from anti-HIV_Chain
  source 1..393: mol_type = other RNA
cgcaccgtcgtcacccagcccccctccgtctccggcgcccccggccagcgcgtcaccatctcctgcaccggctcctcctccaacatcggcgccggctacgacgtccactggtaccagcagctccccggcaccgcccccaagctcctcatctacggcaactccaaccgcccctccggcgtccccgaccgcttctccggctccaagtccggcacctccgcctccctcgccatcaccggcctccaggccgaggacgaggccgactactactgccagtcctacgactcctccctctccggctccggcgtcttcggcaccggcaccaaggtcaccgtcctcggccagcccaaggccaaccccaccgtcaccctcttccccccctcctccgaggagctc

SEQ ID NO: 19753 - RNA, 393 nt, synthetic construct
  misc_feature 1..393: note = derived and/or modified sequence opt2 from anti-HIV_Chain
  source 1..393: mol_type = other RNA
caggtccagctccagcagtggggctccggcctcctcaagccctccgagaccctctccctcacctgcgccgtctacggcggctccttccgctcctactactggaactggatccgccagtcccccggcaagggcctcgagtggatcggcgaggtctcccactccggctccaccaactacaaccccgccctcaagtcccgcgtcaccatctccgtcgacacctccaagaaccagttctccctcaaggtcaagtccgtcaccgccgccgacaccgccctctactactgctcccgcggccgcggcaagcgctgctccggcgcctactgcttcgccggctacttcgactcctggggccagggcggcctcgtcgtcgtctcctccgcctccaccaagggc

SEQ ID NO: 19754 - RNA, 393 nt, synthetic construct
  misc_feature 1..393: note = derived and/or modified sequence opt2 from anti-HIV_Chain
  source 1..393: mol_type = other RNA
caggtccacctcgtccagtccggcgccgaggtcaagaagcccggctcctccgtccgcgtctcctgcgaggcctccggctggaccttcggctccgtcaactccgccatcacctgggtccgccaggcccccggccagggcctcgagtggatgggccgcaccatccccttcctcggcatctccaactacgcccagaagttccagggccgcgtcaccatcaccgccgacaagtccaccaacatcgcctacgtcgacgtcacctccctcacctcccaggacaccgccgtctactactgcgcccgcctcatcaccggcatgaccgccccctggttctactacatggacgtctggggcaagggcaccaccgtcaccgtctcctccgcctccaccaagggc

SEQ ID NO: 19755 - RNA, 393 nt, synthetic construct
  misc_feature 1..393: note = derived and/or modified sequence opt2 from anti-HIV_Chain
  source 1..393: mol_type = other RNA
caggtccacctccaggagtccggcccccgcctcgtccgctcctccgagaccctctccctcacctgctccgtccccggcggctccatcgtcaaccccatcaccaactactactggtcctggatccgccagtccccccgcaagggcctccagtggatcggcgacatctactacaccggcacctcctcccgcaacccctccctcgactcccgcgtctccatctccatggacgtctcccgcaagcagatctccctcaccctctactccgtcaccgccgccgacaccgccgtccactactgcgcctcccagtccctctcctggtaccgcccctccggctacttcgagtcctggggccagggcatcctcgtcaccgtctcctccgcctccaccaagggc

SEQ ID NO: 19756 - RNA, 393 nt, synthetic construct
  misc_feature 1..393: note = derived and/or modified sequence opt2 from anti-HIV_LightChain
  source 1..393: mol_type = other RNA
atgaagctccccgtccgcctcctcgtcctcatgttctggatccccgcctcctcctccgacatcgtcatgacccagtcccccctctccctccccgtcacccccggcgagcccgcctccatctcctgccgctcctcccagcgcctcctctcctcctacggccacacctacctccactggtacctccagaagcccggccagtccccccagctcctcatctacgaggtctccaaccgcttctccggcgtccccgaccgcttctccggctccggctccggcaccgacttcaccctcaagatctcccgcgtcgaggccgaggacgtcggcgtctactactgctcccagtccacccacgtccccctcaccttcggccagggcaccaaggtcgagatcaag

SEQ ID NO: 19757 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccctccgagaccctctccgtcacctgctccgtctccggcgactccatgaacaactactactggacctggatccgccagtcccccggcaagggcctcgagtggatcggctacatctccgaccgcgcctccgccacctacaacccctccctcaactcccgcgtcgtcatctcccgcgacacctccaagaaccagctctccctcaagctcaactccgtcacccccgccgacaccgccgtctactactgcgccaccgcccgccgcggccagcgcatctacggcgtcgtctccttcggcgagttcttctactactactccatggacgtctggggcaagggcaccaccgtcaccgtctcctcc

SEQ ID NO: 19758 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccccccgagaccctctccctcacctgctccgtctccggcgcctccgtcaacgacgcctactggtcctggatccgccagtcccccggcaagcgccccgagtgggtcggctacgtccaccactccggcgacaccaactacaacccctccctcaagcgccgcgtcaccttctccctcgacaccgccaagaacgaggtctccctcaagctcgtcgccctcaccgccgccgactccgccgtctacttctgcgcccgcgccctccacggcaagcgcatctacggcatcgtcgccctcggcgagctcttcacctacttctacatggacgtctggggcaagggcaccaccgtcaccgtctcctcc

SEQ ID NO: 19759 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccctccgagaccctctccctcacctgctccgtctccggcgcctccatctccgactcctactggtcctggatccgccgctcccccggcaagggcctcgagtggatcggctacgtccacaagtccggcgacaccaactactccccctccctcaagtcccgcgtcaacctctccctcgacacctccaagaaccaggtctccctctccctcgtcgccgccaccgccgccgactccggcaagtactactgcgcccgcaccctccacggccgccgcatctacggcatcgtcgccttcaacgagtggttcacctacttctacatggacgtctggggcaacggcacccaggtcaccgtctcctcc

SEQ ID NO: 19760 - RNA, 396 nt, synthetic construct
  misc_feature 1..396: note = derived and/or modified sequence opt2 from anti-HIV_Chain
  source 1..396: mol_type = other RNA
caggtccacctccaggagtccggccccggcctcgtcaagccctccgagaccctctccctcacctgcaacgtctccggcaccctcgtccgcgacaactactggtcctggatgcgccagcccctcggcaagcagcccgagtggatcggctacgtccacgactccggcgacaccaactacaacccctccctcaagtcccgcgtccacctctccctcgacaagtccaacaacctcgtctccctccgcctcaccgccgtcaccgccgccgactccgccacctactactgcgccaccaccaagcacggccgccgcatctacggcatcgtcgccttcaacgagtggttcacctacttctacatggacgtctggggcaagggcaccaccgtcaccgtctcctcc

SEQ ID NO: 19761 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccctccgagaccctctccgtcacctgctccgtctccggcgactccatgaacaactactactggacctggatccgccagtcccccggcaagggcctcgagtggatcggctacatctccgaccgcgagtccgccacctacaacccctccctcaactcccgcgtcgtcatctcccgcgacacctccaccaaccagctctccctcaagctcaactccgtcacccccgccgacaccgccgtctactactgcgccaccgcccgccgcggccagcgcatctacggcgtcgtctccttcggcgagttcttctactactactccatggacgtctggggccgcggcaccaccgtcaccgtctcctcc

SEQ ID NO: 19762 - RNA, 396 nt, synthetic construct
  misc_feature 1..396: note = derived and/or modified sequence opt2 from anti-HIV_Chain
  source 1..396: mol_type = other RNA
caggtccagctcgtcgagtccggccccggcctcgtcaccccctccgagaccctctccctcacctgcaccgtctccaacggctccgtctccggccgcttctggtcctggatccgccagtcccccggccgcggcctcgagtggatcggctacttctccgacaccgaccgctccgagtactccccctccctccgctcccgcctcaccctctccctcgacgcctcccgcaaccagctctccctcaagctcaagtccgtcaccgccgccgactccgccacctactactgcgcccgcgcccagcagggcaagcgcatctacggcatcgtctccttcggcgagttcttctactactactacatggacgcctggggcaagggcaccgccgtcaccgtctcctcc

SEQ ID NO: 19763 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccccccgagaccctctccctcacctgctccgtctccggcgcctccatcaacgacgcctactggtcctggatccgccagtcccccggcaagcgccccgagtgggtcggctacgtccaccactccggcgacaccaactacaacccctccctcaagcgccgcgtcaccttctccctcgacaccgccaagaacgaggtctccctcaagctcgtcgacctcaccgccgccgactccgccgtctacttctgcgcccgcgccctccacggcaagcgcatctacggcatcgtcgccctcggcgagctcttcacctacttctacatggacgtctggggcaagggcaccaccgtcaccgtctcctcc

SEQ ID NO: 19764 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccccccgagaccctctccctcacctgctccgtctccggcgcctccatcaacgacgcctactggtcctggatccgccagtcccccggcaagcgccccgagtgggtcggctacgtccaccactccggcgacaccaactacaacccctccctcaagcgccgcgtctccttctccctcgacaccgccaagaacgaggtctccctcaagctcgtcgacctcaccgccgccgactccgccatctacttctgcgcccgcgccctccacggcaagcgcatctacggcatcgtcgccctcggcgagctcttcacctacttctacatggacgtctggggcaagggcaccaccgtcaccgtctcctcc

SEQ ID NO: 19765 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccctccgagaccctctccgtcacctgctccgtctccggcgactccatgaacaactcctactggacctggatccgccagtcccccggcaagggcctcgagtggatcggctacatctccaagtccgagtccgccaactacaacccctccctcaactcccgcgtcgtcatctcccgcgacacctccaagaaccagctctccctcaagctcaactccgtcacccccgccgacaccgccgtctactactgcgccaccgcccgccacggccagcgcatctacggcgtcgtctccttcggcgagttcttcacctactactccatggacgtctggggcaagggcaccaccgtcaccgtctcctcc

SEQ ID NO: 19766 - RNA, 396 nt, synthetic construct
  misc_feature 1..396: note = derived and/or modified sequence opt2 from anti-HIV_Chain
  source 1..396: mol_type = other RNA
caggtccagctccaggagtccggccccggcctcgtcaagccctccgagaccctctccctcacctgctccgtctccaacggctccgtctccggccgcttctggtcctggatccgccagtcccccggccgcggcctcgagtggatcggctacttctccgacaccgagaagtccaactacaacccctccctccgctcccgcctcaccctctccgtcgacgcctccaagaaccagctctccctcaagctcaactccgtcaccgccgccgactccgccacctactactgcgcccgcacccagcagggcaagcgcatctacggcgtcgtctccttcggcgagttcttccactactactacatggacgcctggggcaagggcaccgccgtcaccgtctcctcc

SEQ ID NO: 19767 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcaccgccctcaagtcccccggctcctccgccaagctctcctgcaccgtcctcggcgacgagttcggcacctacttcatctcctggatccgccaggcccccggccagggcctcgagtgggtcggcggcatcgtcccccactcccagctccagtcctccgcccagaagttccacggccgcatcatcatctccgccggcgccggcgtcaccccccccgtcgtctccctccagctcaccaacctcaccttcgaggacaccggcacctacttctgcgcccgcgagcgcggccgccaccgcgaccccaagaccggcgacgccctccgcggccgctacttcgacttctggggccgcggcaccggcgtctccgtctccgcc

SEQ ID NO: 19768 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcaccgccctcaagtcccccggctcctccgccaagctctcctgcaccgtcctcggcgacgagttcggcacctacttcatctcctggatccgccaggcccccggccagggcctcgagtgggtcggcggcatcgtcccccactcccagctccagtcctccgcccagaagttccacggccgcatcatcatctccgccggcgccggcgtcaccccccccgtcgtctccctccagctcaccaacctcaccttcgaggacaccggcacctacttctgcgcccgcgagcgcggccgccaccgcgaccccaagaccggcaaggccccccgcggccgctacttcgacttctggggccgcggcaccggcgtcaccgtctccgcc

SEQ ID NO: 19769 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcaccgccctcaagtcccccggctcctccgccaagctctcctgcaccgtcctcggcgacgagttcggcacctacttcatctcctggatccgccaggcccccggccagggcctcgagtgggtcggcggcatcgtcccccactcccagctccagtcctccgcccagaagttccacggccgcatcaccatctccgccggcgccggcgtcaccccccccgtcgtctccctccagctcaccaacctcaccttcgaggacaccggcacctacttctgcgcccgcgagcgcggccgccaccgcgaccccaagaccggcgacgccctccgcggccgctacttcgacttctggggccgcggcaccggcgtccgcgtctccacc

SEQ ID NO: 19770 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcgccgccgtcaagtcccccggctcctccgccaagctctcctgcaccgtcctcggcgacgagttcggcacctacttcatctcctggatccgccaggcccccggccagggcctcgagtgggtcggcggcatcgtcccccactcccagctccagtcctccgcccagcgcttccacggccgcatcaccatctccgccggcgccggcgtcaccccccccgtcgtctccctccagctcaccaacctcaccttcgacgacgccggcacctacttctgcgcccgcgagcgcggccgccaccgcgaccccaagaccggcgacgccctccgcggccgctacttcgacttctggggccgcggcaccggcatctccgtctccccc

SEQ ID NO: 19771 - RNA, 396 nt, synthetic construct
  misc_feature 1..396: note = derived and/or modified sequence opt2 from anti-HIV_Chain
  source 1..396: mol_type = other RNA
gaggtccagctcgtccagtccggcgccgaggtcaagaagcccggcgcctccgtcaaggtctcctgcaaggtctccggctacaccctcaccgagctctccatccactgggtccgccaggcccccggcaagggcctcgagtggatgggcggcttcgaccccgaggacgacgaggccatctacgagcccaagttccagggccgcctcaccatgaccgaggacacctccaccgacaccgcctacatggagctctcctccctccgctccgaggacaccgccgtctactactgcgccaccgccgaccccttcaaggtcgcccaggacgagggcctctacgtcatcttcgactactggggccagggcaccctcgtcaccgtctcctccgcctccaccaagggc

SEQ ID NO: 19772 - RNA, 396 nt, synthetic construct
  misc_feature 1..396: note = derived and/or modified sequence opt2 from anti-HIV_Chain
  source 1..396: mol_type = other RNA
gaggtccagctcgtcgagtccggcggcggcctcctccagcccggcggctccctccgcctctcctgcgccgcctccggcttctccttcaacgacttcgagatgaactgggtccgccaggcccccggcaagggcctcgagtgggtctcctacatctccaacgacggcaccatgatccactacgccgactccgtcaagggccgcttcaccatctcccgcgacaacgccaagaagtccctcttcctccagatgaactccctccgcgccgaggacaccgccgtctactactgcgcccgcctcgccgaggtcccccccgccatccgcggctcctactactacggcatggacgtctggggccagggcaccaccgtcaccgtcgcctccgcctccaccaagggc

SEQ ID NO: 19773 - RNA, 396 nt, synthetic construct
  misc_feature 1..396: note = derived and/or modified sequence opt2 from anti-HIV_Chain
  source 1..396: mol_type = other RNA
caggtccagctcatgcagtccggcgccgaggtcaagcgccccggcgcctccgtcaaggtctcctgcaaggccttccgccactccctcaacaacctcggcatctcctggatccgccgcgcccccggccgcggcctcgagtggctcggctggatcaacgtctacgagggcaacaccaagtacggccgccgcttccagggccgcgtcaccatgaccaccgaccgctccaccaacaccgtctccatggagctccgctccctcacctccgacgacaccgccgtctactactgcgcccgcgacaaccacttctggtccggctcctcccgctactactacttcggcatggacgtctggggccagggcaccaccgtcatcgtctcctccgcctccaccaagggc

SEQ ID NO: 19774 - RNA, 396 nt, synthetic construct
  misc_feature 1..396: note = derived and/or modified sequence opt2 from anti-HIV_Chain
  source 1..396: mol_type = other RNA
caggtccagctcgtccagtggggcgccggcctcctcaagcccctcgagaccctctccctcacctgcgccgtctacggcggctccttcaacggctacttctggtcctggatccgccagacccccggcaagggcctcgagtggatcggcgagatcaaccacggcggctccgccaacttcaacccctccctcaagtcccgcgtcaccatgtccgtcgacacctccaagaaccagttctccctcaagctcgcctccgtcaccgccgccgacaccgccatctactactgcgcccgcggccgcatcaccatggtccgcggcgacccccagcgcggcggcgtccgcatggacgtctggggccagggcacctccgtcaccgtctcctccgcctccaccaagggc

SEQ ID NO: 19775 - RNA, 396 nt, synthetic construct
  misc_feature 1..396: note = derived and/or modified sequence opt2 from anti-HIV_Chain
  source 1..396: mol_type = other RNA
ctcgtccagctcgtccagtccggcgccgaggtcaagaagcccggcgcctccgtcaaggtctcctgcaaggtctccggccacaccctctccgagctctccatcaactgggtccgccacgtccccggcaagggcctcgagtggatgggcggcctcgaccccgaggacggcgaggccatccacgagcccaagttccagggccgcctcaccatgaccgaggacacctccaccgacaccgcctactccaccctctccgtctgggcccccgtcgccgccgccatgtactactgcgccaccgccgaccccttcaaggtcgcccaggacgagggcctctacgtcatcttcgactactggggccagggcaccctcgtcaccgtctcctccgcctccaccaagggc

SEQ ID NO: 19776 - RNA, 396 nt, synthetic construct
  misc_feature 1..396: note = derived and/or modified sequence opt2 from anti-HIV_Chain
  source 1..396: mol_type = other RNA
caggtccagctcctccagtccggcggcgaggtcaagaagcccggcgcctccgtcaaggtctcctgcaaggtctccggctacaccctcaccgagctctccatccactgggtccgccaggcccccggcaagggcctcgagtggatgggcggcttcgaccccgaggacgacgaggccatctacgagcccaagttccagggccgcctcaccatgaccgaggacacctccaccgacaccgcctacatggagctctcctccctccgctccgaggacaccgccgtctactactgcgccaccgccgaccccttcaaggtcgcccaggacgagggcctctacgtcatcttcgactactggggccagggcaccctcgtcaccgtctcctccgcctccaccaagggc

SEQ ID NO: 19777 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcgccgaggtcaagaagcccggcgcctccgtcaaggtctcctgcaaggtctccggctacaccctcaccgagctctccatccactgggtccgccaggcccccggcaagggcctcgagtggatgggcggcttcgactccgaggacggcgaggccttctacaagcagaacttccagggccgcgtcaccatgaccgaggacacctccaccgacaccgcctacatggagctccgccgcctccgctccgaggacaccgccgtctactactgcgccaccgccgaccgcttcaaggtcgcccaggacgagggcctcttcgtcatcttcgactactggggccagggcaccctcgtcaccgtctcctccgcctccaccaagggc

SEQ ID NO: 19778 - RNA, 396 nt, synthetic construct
  misc_feature 1..396: note = derived and/or modified sequence opt2 from anti-HIV_Chain
  source 1..396: mol_type = other RNA
caggtccacctcgtccagtccggcgccgaggtcaagaagcccggcgcctccgtccgcgtctcctgcaaggcctccggctacaccttcaccacctacggcatctcctgggtccgccaggcccccggccagggcctcgagtggatgggctggatctccgcccactccggcgacaccaactacgcccagaagctccaggcccgcgtcaccatgaccaccgacacctccaccaacaccgcctacatggagctccgctccctcacctccgacgacaccgccgtctactactgcgcccgcgaccgcccccgccactactacgaccgcggcggctactactcccccttcgactactggggccagggcaccctcgtcaccgtctcctccgcctccaccaagggc

SEQ ID NO: 19779 - RNA, 396 nt, synthetic construct
  misc_feature 1..396: note = derived and/or modified sequence opt2 from anti-HIV_Chain
  source 1..396: mol_type = other RNA
ctcgtccagctcctccagtccggcgccgaggtcaagaagcccggcgcctccgtcaaggtctcctgcaaggtctccggctacaccctcaccgagctctccatccactgggtccgccaggcccccggcaagggcctcgagtggatgggcggcttcgaccccgaggacgacgaggccatctacgagcccaagttccagggccgcctcaccatgaccgaggacacctccaccgacaccgcctacatggagctctcctccctccgctccgaggacaccgccgtctactactgcgccaccgccgaccccttcaaggtcgcccaggacgagggcctctacgtcatcttcgactactggggccagggcaccctcgtcaccgtctcctccgcctccaccaagggc

SEQ ID NO: 19780 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcgccgaggtcaagaagcccggcgcctccgtcaaggtctcctgcaaggtctccggccacaccctctccgagctctccatcaactgggtccgccacgtccccggcaagggcctcgagtggatgggcggcctcgaccccgaggacggcgaggccatccacgagcccaagttccagggccgcctcaccatgaccgaggacacctccaccgacaccgcctacgtcgagctctcctccctccgctccgaggacaccgccatgtactactgcgccaccgccgaccccttcaaggtcgcccaggacgagggcctctacgtcatcttcgactactggggccagggcaccctcgtcaccgtctcctccgcctccaccaagggc

SEQ ID NO: 19781 - RNA, 396 nt, synthetic construct
  misc_feature 1..396: note = derived and/or modified sequence opt2 from anti-HIV_Chain
  source 1..396: mol_type = other RNA
caggtccagctcctccagtccggcgccgaggtcaagaagcccggcgcctccgtcaaggtctcctgcaaggtctccggctacaccctcaccgagctctccatcaactgggtccgccaggcccccggcaagggcctcgagtggatgggcggcttcgaccccgaggacgacgaggccatctacgagcccaagttccagggccgcctcaccatgaccgaggacacctccaccgacaccgcctacatggagctctcctccctccgctccgaggacaccgccgtctactactgcgccaccgccgaccccttcaaggtcgcccaggacgagggcctctacgtcatcttcgactactggggccagggcaccctcgtcaccgtctcctccgcctccaccaagggc

SEQ ID NO: 19782 - RNA, 396 nt, synthetic construct
  misc_feature 1..396: note = derived and/or modified sequence opt2 from anti-HIV_Chain
  source 1..396: mol_type = other RNA
cagccccagctcgtccagtccggctccggcgccgaggtcaagaagcccggcgcctccgtccgcatctcctgcgaggcctccgagtacaacgtcttcgaccacttcatgcagtgggtccgccaggcccccggccagggcctcgagtggatgggctggatcaacccccgcggcggctacccctcctactcccccaccttccagggccgcctcaccttcacccgccagccctcctgggacgactccaccatcaccttccacatggagctccgcggcctcggccacgacgacaccgccgtctactactgcgcccgcccccactcccccgacgacgcctggtccctcgacgtctggggccgcggcaccctcgtcaccgtctcctccgcctccaccaagggc

SEQ ID NO: 19783 - RNA, 396 nt, synthetic construct
  misc_feature 1..396: note = derived and/or modified sequence opt2 from anti-HIV_Chain
  source 1..396: mol_type = other RNA
cagccccagctcgtccagtccggctccggcgccgaggtcaagaagcccggcgcctccgtccgcatctcctgcgaggcctccgagtacaacgtcttcgaccacttcatgcagtgggtccgccaggcccccggccagggcctcgagtggatgggctggatcaacccccgcggcggctacccctcctactccccccgcttccagggccgcctcaccttcacccgccagccctcctgggacgactcctccgtcaccttccacatggagctccgcggcctccgccacgacgacaccgccgtctactactgcgcccgcccccactcccccgacgacgcctggtccctcgacgtctggggccgcggcaccctcgtcaccgtctcctccgcctccaccaagggc

SEQ ID NO: 19784 - RNA, 396 nt, synthetic construct
  misc_feature 1..396: note = derived and/or modified sequence opt2 from anti-HIV_Chain
  source 1..396: mol_type = other RNA
gaggtccagctcgtcgagtccggcggcggcgtcgtcgagcccggcgagtccctccgcctctcctgcgccgcctccggcttcaccttccgctcctacgacatgttctgggtccgccaggccaccggcaagtccctcgagtgggtctccgccatcggcatcgccggcgacacctactactccggctccgtcaagggccgcttcaccatctcccgcgagaacgcccgcacctccctctacctccagctctccggcctccgcgtcgaggactccgccgtctacttctgcgtccgcggctcccccccccgcatcgccgccaccgagtacaactactactacggcctcgacgtctggggccagggcaccaccgtctccgtcttctccgcctccaccaagggc

SEQ ID NO: 19785 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcgccgaggtcaagaagcccggctcctccgtcaaggtctcctgcaaggcctccggcggcaccttcaccacctacgacatctcctgggtccgccaggcccccggccagggcctcgagtggatgggcggcatcctccccgacttcggcgccccctcctacgcccagaagttccaggaccgcgtcaccatcaccaccgacgagtcctcctccaccgcctacatggagctcaactccctccgctccgaggacaccgccatctactactgcgcccgcggccgcggcgacgacttctggtccggcgagtccccctcctggtacttcgactactggggccagggcaccctcgtcaccgtctcctccgcctccaccaagggc

SEQ ID NO: 19786 - RNA, 396 nt, synthetic construct
  misc_feature 1..396: note = derived and/or modified sequence opt2 from anti-HIV_Chain
  source 1..396: mol_type = other RNA
cagccccagctcgtccagtccggctccggcgccgaggtcaagaagcccggcgcctccgtccgcatctcctgcgaggcctccgagtacaacgtcttcgaccacttcatgcagtgggtccgccaggcccccatggagggcctcgagtggatgggctggatcaacccccgcggcggctacccctcctactcccccaccttccagggccgcctcaccttcacccgccagccctcctgggacgactccaccatcaccttccacatggagctccgcggcctccgccacgacgacaccgccgtctactactgcgcccgcccccactcccccgacgacgcctggtccctcgacgtctggggccgcggcaccctcgtcaccgtctcctccgcctccaccaagggc

SEQ ID NO: 19787 - RNA, 396 nt, synthetic construct
  misc_feature 1..396: note = derived and/or modified sequence opt2 from anti-HIV_Chain
  source 1..396: mol_type = other RNA
gaggtccgcctcctcgagtccggcggcggcctcgtccagcccggcggctccctccgcctctcctgctccgcctccggcttcaccttctccaactccgccctctcctgggtccgccaggcccccggcaagggcctcgagtgggtctcctccgtcgtctcctccggcggcgacaccttctacgccgactccgtcaagggccgcttcaccatctcccgcgacaactcccgcaacaccctctacctccagatgaagtccctccgcgccgaggacaccgccctctactactgcgccaaggtccagatccagcagctcaacttcggcgtcatcaccgacgccggcatggacgtctggggcaagggcaccaccgtcatcgtctcctccgcctccaccaagggc

SEQ ID NO: 19788 - RNA, 396 nt, synthetic construct
  misc_feature 1..396: note = derived and/or modified sequence opt2 from anti-HIV_Chain
  source 1..396: mol_type = other RNA
caggtccagctcgtcgagtccggcggcggcgtcgtccagcccggccgctccctccgcctctcctgcgtcggctccggcttcaccttctcctcctccggcatgcactgggtccgccaggcccccggcaagggcctcgagtgggtcgccgtcatctcctccgacggctccgacgagtactacggcgactccgtcgagggccgcttcaccatctcccgcgacaactccaagaacaccctcttcctccagctcgactccctcgaggccgaggactccgccgtctactactgcgccaagacccccccccactacgacgccctcaccggctacccctcctccgtcctcgagttctggggcctcggcaccctcgtcaccgtctcctccgcctccaccaagggc

SEQ ID NO: 19789 - RNA, 396 nt, synthetic construct
  misc_feature 1..396: note = derived and/or modified sequence opt2 from anti-HIV_Chain
  source 1..396: mol_type = other RNA
gaggtccagctcgtccagtccggcgccgaggtcaagaagcccggctcctccgtcaaggtctcctgcaaggcctccggcggcaccttcaccacctacgacatctcctgggtccgccaggcccccggccagggcctcgagtggatcggcggcatcctccccgacttcggcgccccctcctacgcccagaagttccaggaccgcgtcaccatcaccaccgacgagtcctcccgcaccgcctacatggagctcaactccctccgctccgaggacaccgccatctactactgcgcccgcggccgcggcgacgacttctggtccggcgagtccccctcctggtacttcgactactggggccagggcacccaggtcaccgtctcctccgcctccaccaagggc

SEQ ID NO: 19790 - RNA, 396 nt, synthetic construct
  misc_feature 1..396: note = derived and/or modified sequence opt2 from anti-HIV_Chain
  source 1..396: mol_type = other RNA
caggtccagctcctccagtccggcaccgaggtcaagaagcccggctcctccgtcaaggtctcctgccgcgcctccggctggaccctcggcaactcccccaactccgccatcggctgggtccgccaggcccccggccagggcctcgagtggatcggccgcatcatccccatcctcgacgtcaccaactacgcccagaagttccagggccgcgtcaccatctccgccgacaagtccaccaacatcgcctacatggagatctcctccctcggctccgaggacaccgccttctactactgcgcccgcgtcatcaccggcatgacctccccctggtacttctacatggacgtctggggcgagggcaccaccgtcatcgtctcctccgcctccaccaagggc

SEQ ID NO: 19791 - RNA, 396 nt, synthetic construct
  misc_feature 1..396: note = derived and/or modified sequence opt2 from anti-HIV_Chain
  source 1..396: mol_type = other RNA
caggtccacctcgtccagtccggcgccgaggtcaagaagcccggctcctccgtccgcgtctcctgcaaggcctccggctggaccttcggcgactccgtcaactccgccatcacctgggtccgccaggcccccggccagggcctcgagtggatgggccgcttcatccccatcctcggcctctccaactacgcccagaagttccaggaccgcgtcaccatcaacgtcgaccgctccaccaacaccgcctacatggagctctccggcctccgctccgaggacaccgccgtctactactgcgcccgcctcatcaccggcatgaacgccccctggttctactacatggacgtctggggcaagggcaccaccatcaccgtctcctccgcctccaccaagggc

SEQ ID NO: 19792 - RNA, 396 nt, synthetic construct
  misc_feature 1..396: note = derived and/or modified sequence opt2 from anti-HIV_Chain
  source 1..396: mol_type = other RNA
caggtccacctcgtccagtccggcgccgaggccaagcgccccggctcctccgtccgcgtctcctgccgcgcctccggcggcgacttctcctcctacaccctctcctgggtccgccaggcccccggccagggcctcgagcgcatgggcggcgtcgtccccatgctcgacaccgtccactacgcccagaagttccagggccgcctcaccctctccgtcgacgagggcacctccaccgcctacatggagctctcctccctccgctccgaggacaccgccatgtactactgcacccgcggccgccagaccttccgcgccatctggtccggcccccccgtcgtcttcgacatctggggccagggcaccctcgtctccgtctcctccgcctccaccaagggc

SEQ ID NO: 19793 - RNA, 396 nt, synthetic construct
  misc_feature 1..396: note = derived and/or modified sequence opt2 from anti-HIV_Chain
  source 1..396: mol_type = other RNA
caggtccacctcgtccagtccggcgccgaggccaagcgccccggctcctccgtccgcgtctcctgccgcgcctccggcggcgacttctcctcctacaccctctcctgggtccgccaggcccccggccagggcatcgagtggatgggcggcgtcgtccccatgctcgacaccgtccactacgcccagaagttccagggccgcctcaccctctccgtcgacgagggcacctccaccgcctacatggagctctcctccctccgctccgaggacaccgccatgtactactgcacccgcggccgccagaccttccgcgccatctggtccggcccccccgccgtcttcgacatctggggccagggcaccctcgtcatcgtctcctccgcctccaccaagggc

SEQ ID NO: 19794 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcgccgagctcaagaagcccggctcctccgtcaaggtctcctgcaaggcctccggcggcaccttcaacaaccacaccttcaactgggtccgccaggcccccggccagggcctcgagtggatgggccgcaccatccccatcctcggctcccgcgactacgccaagaccttccaggaccgcgtcaccatcatcgccgacaagtccacctccaccgtctacctcgagctccgccgcctcaagtccgaggacaccggcgtctactactgcgccacctccatgtactacttcgactccggcggctactaccgcaacaccgacctcgacaagtggggccagggctccctcgtcaccgtctcctccgcctccaccaagggc

SEQ ID NO: 19795 - RNA, 396 nt, synthetic construct
  misc_feature 1..396: note = derived and/or modified sequence opt2 from anti-HIV_Chain
  source 1..396: mol_type = other RNA
caggtctacctcgtccagtccggccccgagctcaagaagcccggcgcctccgtcaagatctcctgcaaggcctccggctacaacttccccaagtacgccatccactgggtccgccaggcccccggccagggcctccagtggatgggctggatcaacggcgacaacggcgacgcccgctactcccagaagctccagggccgcgtcaccccctccaccgacacctccgcctccgtcgtctacatggagctcaagcgcctccgctccgaggacaccgccgtctactactgcgcccgcgccctctacccctgggagatcggcggcgtcccctccaccatgggcgacgactactggggccagggcaccctcatcaccgtctcctccgcctccaccaagggc

SEQ ID NO: 19796 - RNA, 396 nt, synthetic construct
  misc_feature 1..396: note = derived and/or modified sequence opt2 from anti-HIV_Chain
  source 1..396: mol_type = other RNA
caggtccagctcgtccagtccggccccgagctcatgaagcccggctcctccgtcaaggtctcctgccgcgcctccggcgacaacttcctcacctccaccttcaactggctccgccaggcccccggccagcgcctcgagtggatgggccgcttcatcccctccctcggcctcatcacctccgcccccaagttctccgaccgcctcaccatcaccgccgaccaggccaccctcaccgcctacatggagctcaccggcctcacctccgaggacaccgccctctactactgcgcccgcggcctctgccgcggcggcaactgccgcctcggcccctccggctggctcgacccctggggccgcggcacccaggtcaccgtctcctccgcctccaccaagggc

SEQ ID NO: 19797 - RNA, 396 nt, synthetic construct
  misc_feature 1..396: note = derived and/or modified sequence opt2 from anti-HIV_Chain
  source 1..396: mol_type = other RNA
ggcgtccacttccagggccacctcgtccagtccggcggcggcgtcaagaagcccggctcctccgtcaccatctcctgcctcgcctccgagtacaccttcaccgagttcaccatccactggatccgccaggcccccggccagggccccctctggctcggcctcatcaagcgctccggccgcctcatgacctcctaccgcttccaggaccgcctctccctccgccgcgaccgctccaccggcaccgtcttcatggagctccgcggcctccgcatcgacgacaccgccgtctactactgcgcccgcgacggcctcggcgaggtcgcccccgcctacctctacggcatcgacgtctggggccagggctccaccgtcatcgtcacctccgcctccacctcc

SEQ ID NO: 19798 - RNA, 396 nt, synthetic construct
  misc_feature 1..396: note = derived and/or modified sequence opt2 from anti-HIV_Chain
  source 1..396: mol_type = other RNA
caggtccagctcctccagtccggcgccgaggtcaagaagcccggcgcctccgtcaaggtctcctgcaaggtctccggctacaccctcaccgagctctccatccactgggtccgccaggcccccggcaagggcctcgagtggatgggcggcttcgaccccgaggacgacgaggccatctacgagcccaagttccagggccgcctcaccatgaccgaggacacctccaccgacaccgcctacatggagctctcctccctccgctccgaggacaccgccgtctactactgcgccaccgccgaccccttcaaggtcgcccaggacgagggcctctacgtcatcttcgactactggggccagggcaccctcgtcaccgtctcctccgcctccaccaagggc

SEQ ID NO: 19799 - RNA, 396 nt, synthetic construct
  misc_feature 1..396: note = derived and/or modified sequence opt2 from anti-HIV_Chain
  source 1..396: mol_type = other RNA
caggtccagctcgtccagtccggcgccgaggtcaagaagcccggcgcctccgtcaaggtctcctgcaaggtctccggctacaccctcaccgagctctccatccactgggtccgccaggcccccggcaagggcctcgagtggatgggcggcttcgaccccgaggacggcgaggcctccttcgagcccaagttccagggccgcctcaccatgaccgaggacacctccaccgacaccgcctacatggagctctcctccctccgctccgaggacaccgccgtctactactgcgccaccgccgaccccttcaaggtcgcccaggacgagggcctctacgtcatcttcgactactggggccagggcaccctcgtcaccgtctcctccgcctccaccaagggc

SEQ ID NO: 19800 - RNA, 396 nt, synthetic construct
  misc_feature 1..396: note = derived and/or modified sequence opt2 from anti-HIV_Chain
  source 1..396: mol_type = other RNA
ggcgtccacttccagggccacctcgtccagtccggcggcggcgtcaagaagcccggctcctccgtcaccatctcctgcctcgcctccgagtacaccttcaccgagttcaccatccactggatccgccaggcccccggccagggccccctctggctcggcctcatcaagcgctccggccgcctcatgacctcctaccgcttccaggaccgcctctccctccgccgcgaccgctccaccggcaccgtcttcatggagctccgcggcctccgcatcgacgacaccgccgtctactactgcgcccgcgacggcctcggcgaggtcgcccccgcctacctctacggcatcgacgtctggggccagggcaccaccgtcatcgtcacctccgcctccacctcc

SEQ ID NO: 19801 - RNA, 396 nt, synthetic construct
  misc_feature 1..396: note = derived and/or modified sequence opt2 from anti-HIV_Chain
  source 1..396: mol_type = other RNA
caggtccagctcggcgagtccggcggcggcctcgtcgagcccggcggctccctccgcctctcctgcgccgcctccggcttcctcttctccgactaccagatgtcctggatccgcctcgcccccggcaagggcctcgagtggatctccttcatctccggcttcggctccgtctactacgccgactccgtcgagggccgcttcaccatctcccgcgacaacgcccgcaactccctctacctccagatgaacaacctccgcgccgaggacaccgccgtctactactgcgcccgcgcctacggcaccggcaactggcgcggcctctactactactactacggcatggacgtctggggccacggcaccaccgtcaccgtctcctccgcctccaccaagggc

SEQ ID NO: 19802 - RNA, 399 nt, synthetic construct
  misc_feature 1..399: note = derived and/or modified sequence opt2 from anti-HIV_Chain
  source 1..399: mol_type = other RNA
caggtccagctcgtccagtccggcaccgccctcaagtcccccggctcctccgccaagctctcctgcaccgtcctcggcgacgagttcggcacctacttcatctcctggatccgccaggcccccggccagggcctcgagtgggtcggcggcatcgtcccccactcccagctccagtcctccgcccagaagttccacggccgcatcatcatctccgccggcgccggcgtcaccccccccgtcgtctccctccagctcaccaacctcaccttcgaggacaccggcacctacttctgcgcccgcgagcgcggccgccaccgcgaccccaagaccggcgacgccctccgcggccgctacttcgacttctggggccgcggcaccggcctccgcgtctccacctcc

SEQ ID NO: 19803 - RNA, 399 nt, synthetic construct
  misc_feature 1..399: note = derived and/or modified sequence opt2 from anti-HIV_Chain
  source 1..399: mol_type = other RNA
gaggtccagctcgtccagtccggcggcggcctcgtcaagcccggcggctccctccgcctctcctgcgccgcctccggcttcaccttcaagaacgcctggatgtcctgggtccgccaggcccccggcaagggcctcgagtgggtcggccacatcaagtccaagaccgacggcggcaccatcgactacgccgcccccgtcaagggccgcttcaccatctcccgcgacgactccaagaacaccctctacctccagatgaactccctcaagatcgaggacaccgccgtctactactgcaccaccgacatcggctccggccgcggctgggacttccactactacgactccaacgactggggccagggcaccctcgtcaccgtctcctccgcctccaccaagggc

SEQ ID NO: 19804 - RNA, 399 nt, synthetic construct
  misc_feature 1..399: note = derived and/or modified sequence opt2 from anti-HIV_Chain
  source 1..399: mol_type = other RNA
caggtccagctcgtcgagtccggcggcggcgtcgtccagcccggccgctccctccgcctcttctgcgccgcctccggcttcgccttcaacacctacggcatgcactgggtccgccaggcccccggcaagggcctcgagtgggtcgccgtcacctggcacgacggctcccagaagtactacgccgactccgtcaagggccgcttcaccatctcccgcgacaactccaagaacaccctctacctccagatgaactccctccgcgccgaggacaccgccatctactactgcgcctccgaccagggcggcttcgacgactcctccggctacttcgcccccggcggcatggacgtctggggccgcggcaccaccgtcatcgtctcctccgcccccaccaagggc

SEQ ID NO: 19805 - RNA, 399 nt, synthetic construct
  misc_feature 1..399: note = derived and/or modified sequence opt2 from anti-HIV_Chain
  source 1..399: mol_type = other RNA
ggctactccgaggtccagctcgtccagtccggccccggcctcgtcaagccctcccagaccctctccctcacctgcaccgtctccggcggctccatctccaacggcggccactactggaactggatccgccagcaccccggcaagggcctcgagtggatcggccacatctacaacatcgccaccacctactacaacccctccctcaagtcccgcgtctccatctccgtcgacacctccaagaaccagttctccctcaagctctcctccgtcaccgccgccgacaccgccgtctactactgcgcccgcggctccggccgctggaccatcggcgcccgcatctacttcgacaactggggccagggcgccctcgtcgccgtctcctccgcctccaccaagggc

SEQ ID NO: 19806 - RNA, 399 nt, synthetic construct
  misc_feature 1..399: note = derived and/or modified sequence opt2 from anti-HIV_Chain
  source 1..399: mol_type = other RNA
cagctccagctcaaggagtccggccccggcatggtcaagccctccgagaccctctccctcacctgctccgtctccggcgcctccgtcgtctccgccaacgactactggggctggatccgccaggcccccggcaagggcctcgagtgcatcggcatcatcctctacaccggctccaccttctacaacccctccctccagtcccgcgtcaccatctcccgcgacccctccaagaaccacgtctccctcaccctcacctccgtcaccgccgccgactccgccgtctactactgcgcccgcatcccctaccactccgagtcctactacaacgtcgtcatcggcggcttcgacgtctggggccagggcacccgcgtcaccgtctcctccgcctccaccaagggc

SEQ ID NO: 19807 - RNA, 399 nt, synthetic construct
  misc_feature 1..399: note = derived and/or modified sequence opt2 from anti-HIV_Chain
  source 1..399: mol_type = other RNA
tgccaggtccagctcgtcgagtccggcggcggcgtcgtccagcccggccgctccctccgcctctcctgcgtcggctccggcttcaccttctcctcctccggcatgcactgggtccgccaggcccccggcaagggcctcgagtgggtcgccgtcatctcctccgacggctccgacgagtactacggcgactccgtcgagggccgcttcaccatctcccgcgacaactccaagaacaccctcttcctccagctcgactccctcgaggccgaggactccgccgtctactactgcgccaagacccccccccactacgacgccctcaccggctacccctcctccgtcctcgagttctggggcctcggcaccctcgtcaccgtctcctccgcctccaccaagggc

SEQ ID NO: 19808 - RNA, 399 nt, synthetic construct
  misc_feature 1..399: note = derived and/or modified sequence opt2 from anti-HIV_Chain
  source 1..399: mol_type = other RNA
caggtccagctcgtccagtccggcgccgacgtcaagaagcccggcgcctccgtcaaggtctcctgcaaggtctccggctacaccgtctccgagctctccatccactgggtccgccaggcccccggcaagggcctcgagtggatgggcggcttcgaccccgaggacggcaagaccgtctccgcccagaacttccagggccgcgtcaccatgaccgaggacaagtccaccggcaccgccaacatggagctccgctccctccgctccgaggacaccgccgtctactactgcgccaccaccgtccagctcatcgtcgacttctgcaacggcggcccctgctacaacttcgacgactggggccagggcaccctcgtcaccgtctcctccgcctccaccaagggc

SEQ ID NO: 19809 - RNA, 399 nt, synthetic construct
  misc_feature 1..399: note = derived and/or modified sequence opt2 from anti-HIV_Chain
  source 1..399: mol_type = other RNA
ggcctcgacctcgagcacgacggccaccacaaggaggagccccgcgcctccgtcaccgtctcctgcgaggcctccggctacaacttcgtcaactacatcatccactgggtccgcctcacccccggccgcggcttcgagtggatgggcatgatcgacccccgccgcggccgcccctggtccgcccagaagttccagggccgcctcaccctcacccgcgacatcgactccgagcgcctctacatgcagctctccggcctccgcggcgacgacaccgccgtctacttctgcgcccgccaggagcccgacttccacgacggccacggccacaccctccgcggcatgttcgactcctggggccagggctcccccgtctccgtctcctccgcctccaccaagggc

SEQ ID NO: 19810 - RNA, 399 nt, synthetic construct
  misc_feature 1..399: note = derived and/or modified sequence opt2 from anti-HIV_Chain
  source 1..399: mol_type = other RNA
caggtccgcctcgtccagtccggcgcccagctcaagaagcccggcgcctccgtcaccgtctcctgcgaggcctccggctacaacttcgtcaactacatcatcaactgggtccgccagacccccggccgctccttcgagtgggtcggcatgatcgacccccgccgcggccgcccctggtccgcccagaagttccagggccgcctcaccctcacccgcgacatcgactccgagaagctctacatgcacctctccggcctccgcggcgacgacaccgccgtctactactgcgcccgccaggactccgacttccacgacggccacggccacaccctccgcggcatgttcgactcctggggccagggctcccccgtcaccgtctcctccgcctccaccaagggc

SEQ ID NO: 19811 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccgtcgtcaagaccggcgcctccgtcaccatctcctgcgagaccgagggctacaccttcgtcaactacatcatccactgggtccgccagccccccggccgcggcttcgagtggctcggcatgatcgacccccgcaacggccacccctggttcggccagcgcttccgcggccgcctctccctccgccgcgaccgctccaccgagaccgtcttcatgaccctctccggcctcacctccgacgacaacggcatctacttctgcgcccgcaacgagccccagtactacgacggctccggccactccctccccggcatgttcgactactggggccagggcacccgcgtcgtcgtctcctccgcctccaccaagggc

SEQ ID NO: 19812 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccgtcatgaagaccggcgcctccgtcaccatctcctgcgagaccgagggctacaacttcgtcaactacatcatccactgggtccgccgcccccccggccgcggcttcgagtggctcggcatgatcgaccccaagaacggccacccctggttcgcccaggccgtccgcggccgcctctccctccgccgcgacaccttcaacgaggtcgtctacatgaccctctccggcctcacctccgacgacaccggcctctacttctgcgcccgcaacgagccccagtaccacgacggcaacggccactccctccccggcatgttcgacttctggggccagggcaccctcgtcaccgtctcctccgcctccaccaagggc

SEQ ID NO: 19813 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccgtcgtcaagaccggcgcctccgtcaccatctcctgcgagaccgagggctacaccttcgtcaactacatcatccactgggtccgccagccccccggccgcggcttcgagtggctcggcatgatcgacccccgcaacggccacccctggttcggccagcgcctccagggccgcctctccctccgccgcgaccgctccaccgagaccgtcttcatgaccctctccggcctcacctccgacgacaccggcatctacttctgcgcccgcaacgagccccagtactacgacggctccggccactccctccccggcatgttcgactactggggccagggcacccgcgtcgtcgtctcctccgcctccaccaagggc

SEQ ID NO: 19814 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccgtcgtcaagaccggcgcctccgtcaccatctcctgcgagaccgagggctacaccttcgtcaaccacatcatccactgggtccgccagccccccggccgcggcttcgagtggctcggcatgatcgacccccgcaacggccacccctggttcggccagcgcctccgcggccgcctctccctccgccgcgaccgctccaccgagaccgtcttcatgaccctctccggcctcacctccgacgacatcggcatctacttctgcgcccgcaacgagccccagtacttcgacggctccggccactccctccccggcatgttcgactactggggccagggcacccgcgtcgtcgtctcctccgcctccaccaagggc

SEQ ID NO: 19815 - RNA, 399 nt, synthetic construct
  misc_feature 1..399: note = derived and/or modified sequence opt2 from anti-HIV_Chain
  source 1..399: mol_type = other RNA
caggtccagttcttccagtccggctcctccatgaagaagtccggcgcctccgtcaccatctcctgcgaggccaccggctacaacatcaagaaccacatcctccactgggtccgccagaagcccggccgcggcttcgagtgggtcggcatgatcgaccccatcaacggccgcccctggttcggccaggccttccgcggccgcctcaccctcacccgcgacctctccaccgagaccttctacatgtccctctccggcctcacctccgacgacaccgccacctacttctgcgcccgccgcgaggccgactaccacgacggcaacggccacaccctccccggcatgttcgacttctggggccccggcaccctcgtcaccgtctcctccgcctccaccaagggc

SEQ ID NO: 19816 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccgtcgtcaagaccggcgcctccgtcaccatctcctgcgagaccgagggctacaccttcgtcaactacatcatccactgggtccgccagtcccccggccgcggcttcgagtggctcggcatgatcgacccccgcaacggccacccctggttcggccagcgcctccgcggccgcctctccctccgccgcgaccgctccaccgagaccgtcttcatgaccctctccggcctcacctccgacgacaccgccatctacttctgcgcccgcaacgagccccagtactacgacggctccggccactccctccccggcatgttcgactactggggccagggcacccgcgtcgtcgtctcctccgcctccaccaagggc

SEQ ID NO: 19817 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccatgaagaagcccggcgcctccgtcaccatctcctgcgagaccgagggctacaccttcatcaactacatcatccactgggtccgccagccccccggccgcggcttcgagtggctcggcatgatcgacccccgcaacggccgcccctggttcggccagtccgtccagggccgcctctccctccgccgcgacacctacaccgaggtcgtctacatgaccctctccggcctcacctccgacgacgccggcctctacttctgcgcccgcaacgagccccagtaccacgacggcaacggccactccctccccggcatgttcgactactggggccagggcaccctcgtcgccgtctcctccgcctccaccaagggc

SEQ ID NO: 19818 - RNA, 399 nt, synthetic construct
  misc_feature 1..399: note = derived and/or modified sequence opt2 from anti-HIV_Chain
  source 1..399: mol_type = other RNA
caggtccgcctcgtccagtccggcgcccagctcaagaagcccggcgcctccgtcaccgtctcctgcgaggcctccggctacaacttcgtcaactacatcatcaactgggtccgccagacccccggccgcggcttcgagtgggtcggcatgatcgacccccgccgcggccgcccctggtccgcccagaagttccagggccgcctcaccctcacccgcgacatcgactccgagaagctctacatgcacctctccggcctccgcggcgacgacaccgccgtctactactgcgcccgccaggactccgacttccacgacggccacggccacaccctccgcggcatgttcgactcctggggccagggctcccccgtcaccgtctcctccgcctccaccaagggc

SEQ ID NO: 19819 - RNA, 399 nt, synthetic construct
  misc_feature 1..399: note = derived and/or modified sequence opt2 from anti-HIV_Chain
  source 1..399: mol_type = other RNA
caggtccacaccttccagtccggctcctccatgaagaagtccggcgcctccgtcaccatctcctgcgaggccaccggctacaacatcaagaactacatcctccactgggtccgccagaagcccggccgcggcttcgagtgggtcggcatgatcgaccccatcaacggccgcccctggttcggccagcccttccgcggccgcctcaccctcacccgcgacctctccaccgagaccttctacatgtccctctccggcctcacctccgacgacaccgccacctacttctgcgcccgccgcgaggccgactaccacgacggcaacggccacaccctccccggcatgttcgacttctggggccccggcaccctcatcaccgtctcctccgcctccaccaagggc

SEQ ID NO: 19820 - RNA, 399 nt, synthetic construct
  misc_feature 1..399: note = derived and/or modified sequence opt2 from anti-HIV_Chain
  source 1..399: mol_type = other RNA
caggtccgcctcttccagtccggcgccgccatgaagaagcccggcgcctccgtcaccatctcctgcgaggcctccggctacaacttcatgaactacttcgtccactgggtccgccagcgccccggccgcggcttcgagtggctcggcatgatcaacccccgcggcggccgcccctggtccgcccagtccgtccagggccgcctcaccctcacccgcgacatctccaccgagatgttctacatgcgcctcgacggcctccgctccgacgacaccgccacctacttctgcgcccgcaacgaggccgactaccacgacggcaacggccactccctccgcggcatgttcgactactggggccagggctccctcatcaccgtctcctccgcctccaccaagggc

SEQ ID NO: 19821 - RNA, 399 nt, synthetic construct
  misc_feature 1..399: note = derived and/or modified sequence opt2 from anti-HIV_Chain
  source 1..399: mol_type = other RNA
caggtccagctcttccagtccggcgccgccatgcgcaagcccggcgcctccgtcaccatctcctgcgaggcctccggctacaacttcatgaactacttcgtccactgggtccgccagcgccccggccgcggcttcgagtggctcggcatgatcaacccccgcggcggccgcccctggtccgcccagtccgtccagggccgcctcaccctcacccgcgacacctccaccgagatgttctacatgcgcctcgacggcctccgctccgacgacaccgccacctacttctgcgcccgcaacgaggccgactaccacgacggcaacggccactccctccgcggcatgttcgactactggggccagggctccctcatcaccgtctcctccgcctccaccaagggc

SEQ ID NO: 19822 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccatcaagaagcccggcgcctccgtcaccatctcctgcgagaccgagggctacaccttcatcaactacatcatccactgggtccgccagccccccggccgcggcttcgagtggctcggcatgatcgacccccgcaacggccgcccctggttcggccagtccgtccagggccgcctctccctccgccgcgacacctacaccgaggtcgtctacatgaccctctccggcctcacctccgacgacaccggcctctacttctgcgcccgcaacgagccccagtaccacgacggcaacggccactccctccccggcatgttcgactcctggggccagggcaccctcgtcgccgtctcctccgcctccaccaagggc

SEQ ID NO: 19823 - RNA, 399 nt, synthetic construct
  misc_feature 1..399: note = derived and/or modified sequence opt2 from anti-HIV_Chain
  source 1..399: mol_type = other RNA
caggtccgcctcttccagtccggcgccgccatgcgcaagcccggcgcctccgtcaccatctcctgcgaggcctccggctacaacttcctcaactacttcgtccactgggtccgccagcgccccggccgcggcttcgagtggctcggcatgatcaacccccgcggcggccgcccctggtccgcccagtccgtccagggccgcctcaccctcacccgcgacacctccaccgagatgttctacatgcgcctcgacggcctccgctccgacgacaccgccacctacttctgcgcccgcaacgaggccgactaccacgacggcaacggccactccctccgcggcatgttcgactactggggccagggctccctcatcaccgtctcctccgcctccaccaagggc

SEQ ID NO: 19824 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccgtcaagaagcccggcgcctccgtcaccatcgtctgcgagaccgagggctacaacttcatcgactacatcatccactgggtccgccagccccccggccgcggcttcgagtggctcggcatgatcgacccccgcaacggccgcccctggtccggccagaaggtccacggccgcctctccctctggcgcgacacctccaccgagaaggtctacatgaccctcaccggcctcacctccgacgacaccggcctctacttctgcggccgcaacgagccccagtaccacgacgacaacggccactccctccccggcatgatcgactactggggccagggcaccatggtcaccgtctcctccgcctccaccaagggc

SEQ ID NO: 19825 - RNA, 399 nt, synthetic construct
  misc_feature 1..399: note = derived and/or modified sequence opt2 from anti-HIV_Chain
  source 1..399: mol_type = other RNA
caggtccgcctctcccagtccggcgccgccatcaagaagcccggcgcctccgtcaccatctcctgcgagaccgagggctacaccttcatcaactacatcatccactgggtccgccagccccccggccgcggcttcgagtggctcggcatgatcgacccccgcaacggccgcccctggttcggccagtccgtccagggccgcctctccctccgccgcgacacctacaccgaggtcgtctacatgaccctctccggcctcacctccgacgacgccggccactacttctgcgcccgcaacgagccccagtaccacgacggcaacggccactccctccccggcatgttcgactactggggccagggcaccctcgtcgccgtctcctccgcctccaccaagggc

SEQ ID NO: 19826 - RNA, 399 nt, synthetic construct
  misc_feature 1..399: note = derived and/or modified sequence opt2 from anti-HIV_Chain
  source 1..399: mol_type = other RNA
caggtccgcctcttccagtccggcgccgccatgcgcaagcccggcgcctccgtcaccatctcctgcgaggcctccggctacaacttcatgaactacttcgtccactgggtccgccagcgccccggccgcggcttcgagtggctcggcatgatcaacccccgcggcggccgcccctggtccgcccagtccgtccagggccgcctcaccctcacccgcgacacctccaccgagatgttctacatgcgcctcgacggcctccgctccgacgacaccgccacctacttctgcgcccgcaacgaggccgactaccacgacggcaacggccactccctccgcggcatgttcgactactggggccagggctccctcatcaccgtctcctccgcctccaccaagggc

SEQ ID NO: 19827 - RNA, 399 nt, synthetic construct
  misc_feature 1..399: note = derived and/or modified sequence opt2 from anti-HIV_LightChain
  source 1..399: mol_type = other RNA
atgaagctccccgtccgcctcctcgtcctcatgttctggatccccgcctcctcctccgacatcgtcatgacccagtcccccctctccctccccgtcacccccggcgagcccgcctccatctcctgccgctcctcccagcgcctcctctcctcctacggccacacctacctccactggtacctccagaagcccggccagtccccccagctcctcatctacgaggtctccaaccgcttctccggcgtccccgaccgcttctccggctccggctccggcaccgacttcaccctcaagatctcccgcgtcgaggccgaggacgtcggcgtctactactgctcccagtccacccacgtccccctcaccttcggccagggcaccaaggtcgagatcaagcgcaag

SEQ ID NO: 19828 - RNA, 402 nt, synthetic construct
  misc_feature 1..402: note = derived and/or modified sequence opt2 from anti-HIV_Chain
  source 1..402: mol_type = other RNA
cagccctacatcgtccagtccggccccgccgtcaagggcgccggctcctccgtcaccgtcacctgcaaggtcgacggcgacgacgacggcatcttctccttcggcacctacttcatggtctgggtccgccaggcccccggccagggcctccagtacatgggcggcctcgtcccctcctacgcccccacctacgcccacaagttcgagggccgcatcaccatctccgccgccggcaccccccccgtcgtctccctcaccctcctcaacctcaccaacgacgacgccgccacctacttctgcgcccgcgagcgcggccgccactacgactccaagacccgcgagaaccgccgcggccgctacttcgacatgtggggccgcggcacccgcatcaccgtctccccc

SEQ ID NO: 19829 - RNA, 402 nt, synthetic construct
  misc_feature 1..402: note = derived and/or modified sequence opt2 from anti-HIV_Chain
  source 1..402: mol_type = other RNA
cagccctacatcgtccagtccggccccgccgtcaagggcgccggctcctccgtcaccgtcacctgccgcgtcgacggcgacgacgacggcatcttcaacttcggcacctacttcatggtctgggtccgccaggcccccggccagggcctccagtacatgggcggcctcgtcccctcctacgcccccacctacgcccacaagttcgagggccgcatcaccatctccgccgccggcaccccccccgtcgtctccctcaccctcatcaacctcaccaacgccgacgccgccacctacttctgcgcccgcgagcgcggccgccactacgactccaagacccgcgagaaccgccgcggccgctacttcgacatgtggggccgcggcacccgcatcaccgtctccccc

SEQ ID NO: 19830 - RNA, 402 nt, synthetic construct
  misc_feature 1..402: note = derived and/or modified sequence opt2 from anti-HIV_Chain
  source 1..402: mol_type = other RNA
cgcgtccactcccaggtccagctcgtcgagtccggccccggcctcgtcaagccctcccagaccctctccctcacctgcaccgtctccggcggctccatctccaacggcggccactactggaactggatccgccagcaccccggcaagggcctcgagtggatcggccacatctacaacatcgccaccacctactacaacccctccctcaagtcccgcgtctccatctccgtcgacacctccaagaaccagttctccctcaagctctcctccgtcaccgccgccgacaccgccgtctactactgcgcccgcggctccggccgctggaccatcggcgcccgcatctacttcgacaactggggccagggcgccctcgtcgccgtctcctccgcctccaccaagggc

SEQ ID NO: 19831 - RNA, 402 nt, synthetic construct
  misc_feature 1..402: note = derived and/or modified sequence opt2 from anti-HIV_Chain
  source 1..402: mol_type = other RNA
tccgtcgacgagcgcctcctcgagttcggcggccgcctcgtccagcccggcggctccctccgcctctcctgctccgcctccggcttcaccttctccaactccgccatgtcctgggtccgccaggcccccggcaagggcctcgagtgggtctcctccatcctctcctccggcgtcggcaccttctacgccgactccgtcaagggccgcttcaccgtctcccgcgacaactcccgcaacaccctctacctccagatgaagtccctccgcgccgaggacaccgccctctactactgcgccaaggtccagatccagcagctcaacttcggcgtcatcaccgacgccggcctcgacgtctggggcaagggcaccaccctcatcgtctcctccgcctccaccaagggc

SEQ ID NO: 19832 - RNA, 402 nt, synthetic construct
  misc_feature 1..402: note = derived and/or modified sequence opt2 from anti-HIV_Chain
  source 1..402: mol_type = other RNA
gtccagtcccaggtctacctcgtccagtccggcggcgaggtcaagaagcccggctcctccgtcaaggtctcctgcaaggcctccggcgactccttctcctcctccgtcatcacctgggtccgccaggcccccggccagggccccgagtggatgggccgcatcatccccgtcctcggcgtcgccgcctacgcccagaacttctacggccgcgtcaccatctccgccgacacctcctccaacaccgcctacatggagctctcctccctccgcttcgaggacaccgccgtcttctactgcgcccgcgagaccggccgcggcggcaacctcgccctccgccagtacttcttcgactcctggggccagggcaccctcgtcaccgtctcctccccctccaccaagggc

SEQ ID NO: 19833 - RNA, 402 nt, synthetic construct
  misc_feature 1..402: note = derived and/or modified sequence opt2 from anti-HIV_Chain
  source 1..402: mol_type = other RNA
cagctccagctccaggagtccggccccggcctcgtcaagccctccgagaccctctccctcacctgctccgtctccgacggctccatcaactccaactcctactactgggcctggatccgccagtcccccggcaagggcctcgagtggatcggctccgtctactacttcggcggcacctactactccccctccctcaagtcccgcgtcaccatgtccgtcgaccgctccaagaaccagttctccctcaacgtctcctccgtcaccgccgccgacaccgccatctactactgcgcccgccacgtccgcccctacgaccgctccggctaccccgagcgccccaactggttcgacccctggggccgcggcaccctcgtcaccgtctcctccgcctccaccaagggc

SEQ ID NO: 19834 - RNA, 402 nt, synthetic construct
  misc_feature 1..402: note = derived and/or modified sequence opt2 from anti-HIV_Chain
  source 1..402: mol_type = other RNA
caggtccagctccaccagtggggcgccggcctcctcaagccctccgacaccctctccctcacctgcggcatcctcggcgtctccccccccggctccctcaccggctactactggacctggatccgccagccccccggcaagggcctcgagtggatcggcgaggtctaccactccggctccaccaactacaacccctccctcgcctcccgcgtcaccatctccatgggcaccaccaagacccagttctccctccgcctcacctccgtcaccgccgccgactccgccgtctactactgcgcctccggcaaggtctggggcatcaccgcccgcccccgcgacgccggcctcgacgtctggggccagggcaccaccgtcaccgtcacctccgcctccaccaagggc

SEQ ID NO: 19835 - RNA, 402 nt, synthetic construct
  misc_feature 1..402: note = derived and/or modified sequence opt2 from anti-HIV_Chain
  source 1..402: mol_type = other RNA
caggtccagctcgtccagtccggcgccgaggtcaagaagcccggctcctccgtcaaggtctcctgccgcgcctccggcggctccttcggcaactacgccatcaactgggtccgccaggcccccatgcagggcctcgagtggatgggcggcatcatccccatcttcggcaccaccaactacgcccagaacttccgcggccgcgtcaccatcaacgccgacaccttcaccaacaccgtcaacatggacctctcctccctccgctccgaggacaccgccgtctactactgcggccgctccatcaacgccgccgtccccggcctcgagggcgtctactactactacggcatggccgtctggggccagggcaccaccgtcaccgtctcctccgcctccaccaagggc

SEQ ID NO: 19836 - RNA, 402 nt, synthetic construct
  misc_feature 1..402: note = derived and/or modified sequence opt2 from anti-HIV_Chain
  source 1..402: mol_type = other RNA
ttcgtccagctcgtcgagtccggcggcggcctcgtccagcccggcggctccctccgcctctcctgcgccgcctccggcttcaacttcaacacctactggatgaactgggtccgccaggcccccggcaagggcctcgagtgggtcgccaacatgaaggaggacggctccgagaagtactacgtcgactccgtcaagggccgcttcaccatctcccgcgacaacgccaagaactccctctacctccagatgaactccctccgcgccgaggacaccgccgtctactactgcgcccgcaaccccgagtcccgctgcatcgtcggccgcaaccgcggctggtgccgctacttcgacctctggggccgcggctccctcgtcaccgtctcccccgcctccaccaagggc

SEQ ID NO: 19837 - RNA, 405 nt, synthetic construct
  misc_feature 1..405: note = derived and/or modified sequence opt2 from anti-HIV_Chain
  source 1..405: mol_type = other RNA
cagctccagctcgaccagcccggcgccgccatgaagtccctcggctcctccctcaccatcacctgccgcgtctccggcgacgacctcggctccttccacttcggcacctacttcatgatctgggtccgccagggccccggccagggcctcgagtacatgggcggcatcctcccctccaccaagacccccacctacgcccacaagttccgcggccgcgtctccatctccgcccccggcgtcccccccgtcctctccctcgccctcaccaacctcacctacgacgacaccgccacctacttctgcgcccgcgagcgcggccgccacttcgagcccaagaaccgcgaccacctcgagggcaagttcctcgacctctggggccgcggcaccttcgtccgcgtctccccc

SEQ ID NO: 19838 - RNA, 405 nt, synthetic construct
  misc_feature 1..405: note = derived and/or modified sequence opt2 from anti-HIV_Chain
  source 1..405: mol_type = other RNA
caggtccagctcgtccagcccggcaccgccatgaagtccctcggctcctccctcaccatcacctgccgcgtctccggcgacgacctcggctccttccacttcggcacctacttcatgatctgggtccgccaggcccccggccagggcctcgagtacatgggcggcatcctcccctccaccaagacccccacctacgcccacaagttccgcggccgcgtctccatctccgcccccggcgtcccccccgtcctctccctcgccctcaccaacctcacctacgacgacaccgccacctacttctgcgcccgcgagcgcggccgccacttcgagcccaagaaccgcgacaacctcgagggcaagttcttcgacctctggggccgcggcaccttcgtccgcgtctccccc

SEQ ID NO: 19839 - RNA, 405 nt, synthetic construct
  misc_feature 1..405: note = derived and/or modified sequence opt2 from anti-HIV_Chain
  source 1..405: mol_type = other RNA
caggtccagctcgtccagcccggcaccgccatgaagaccctcggctcctccctcaccatctcctgccgcgtctccggcgacgacggcaacttccacttcggcacctacttcatggcctgggtccgccaggtccccggccagggcctcgagtacatgggcggcatcctcccctccaccaagtcccccacctacgcccacaagttccgcggccgcgtctccatctccaccgccggcgtcccccccgtcgtctccctcgccctcaccaacctcacctacgacgacaccgccacctacttctgcgcccgcgagcgcggccgccactacgactccaagaagcaggagaactaccgcggcaagttcttcgacctctggggccgcggcacctgggtccgcgtctcccccacc

SEQ ID NO: 19840 - RNA, 405 nt, synthetic construct
  misc_feature 1..405: note = derived and/or modified sequence opt2 from anti-HIV_Chain
  source 1..405: mol_type = other RNA
cacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgaccagtggtccggcctccaccacgacggcgtcatggccttctcctcctggggccagggcaccctcatctccgtctccgccgcctccaccaagggc

SEQ ID NO: 19841 - RNA, 405 nt, synthetic construct
  misc_feature 1..405: note = derived and/or modified sequence opt2 from anti-HIV_Chain
  source 1..405: mol_type = other RNA
caggtccagctcgtccagtccggcgccgaggtcaagaagcccggctcctccgtcaaggtctcctgcaaggcctccggcggcaccttctccacctacgccttctcctgggtccgccaggcccccatcgagggcctcgagtggatgggcggcatcatccccatcttcggcaccgagaactacgcccagaagttccagggccgcgtcaccatcaccgccgacaagtccacctccaccgcctacatggagctctcctccctccgctccgaggacaccgccgtctactactgcgcccgcgaccgctcctccgccatcggctactgctcctccatctcctgctacaagggctccttcgacatctggggccagggcaccatggtcaccgtctcctccgcctccaccaagggc

SEQ ID NO: 19842 - RNA, 405 nt, synthetic construct
  misc_feature 1..405: note = derived and/or modified sequence opt2 from anti-HIV_Chain
  source 1..405: mol_type = other RNA
caggtccagctcgtccagtccggcgccgaggtcaagaagcccggctcctccgtcaaggtctcctgcaaggcctccggcggcaccttctccacctacgccttctcctgggtccgccaggcccccggccagggcctcgagtggatgggcggcatcatccccatcttcggcaccgagaactacgcccagaagttccagggccgcgtcaccatcaccgccgacaagtccacctccaccgcctacatggagctctcctccctccgctccgaggacaccgccgtctactactgcgcccgcgaccgctcctccgccatcggctactgctcctccatctcctgctacaagggctccttcgacatctggggccagggcaccatggtcaccgtctcctccgcctccaccaagggc

SEQ ID NO: 19843 - RNA, 405 nt, synthetic construct
  misc_feature 1..405: note = derived and/or modified sequence opt2 from anti-HIV_Chain
  source 1..405: mol_type = other RNA
gaggtccagctcgtcgagtccggcggcggcctcgtccagcccggcggctccctccgcctctcctgcgccgcctccggcttcaccttctcctcctactccatgaactgggtccgccaggcccccggcaagggcctcgagtgggtctcctacatctccggctcctcctacaccatctactacgccgactccgtccgcggccgcttcaccatctcccgcgacaacgccaagaactccctctacctccagatgaactccctccgcgacgaggacaccgccgtctacttctgcgcccgcgccaccccccccaaccccctcaacctctacaactacgactcctccggctcctccttcgactactggggccagggcaccctcgtcaccgtctcctccgcctccaccaagggc

SEQ ID NO: 19844 - RNA, 405 nt, synthetic construct
  misc_feature 1..405: note = derived and/or modified sequence opt2 from anti-HIV_Chain
  source 1..405: mol_type = other RNA
gaggtccagctcgtccagtccggcgccgaggtcaagaagcccggctcctccgtcaaggtctcctgcaaggcctccggcggcaccttctccacctacgccttctcctgggtccgccaggcccccggccagggcctcgagtggatgggcggcatcatccccatcttcggcaccgagaactacgcccagaagttccagggccgcgtcaccatcaccgccgacaagtccacctccaccgcctacatggagctctcctccctccgctccgaggacaccgccgtctactactgcgcccgcgaccgctcctccgccatcggctactgctcctccatctcctgctacaagggctccttcgacatctggggccagggcaccatggtcaccgtctcctccgcctccaccaagggc

SEQ ID NO: 19845 - RNA, 405 nt, synthetic construct
  misc_feature 1..405: note = derived and/or modified sequence opt2 from anti-HIV_Chain
  source 1..405: mol_type = other RNA
gaggtccagctcgtcgagtccggcgccgaggtcaagaagcccggctcctccgtcaaggtctcctgcaaggcctccggcggcaccttctccacctacgccttctcctgggtccgccaggcccccggccagggcctcgagtggatgggcggcatcatccccatcttcggcaccgagaactacgcccagaagttccagggccgcgtcaccatcaccgccgacaagtccacctccaccgcctacatggagctctcctccctccgctccgaggacaccgccgtctactactgcgcccgcgaccgctcctccgccatcggctactgctcctccatctcctgctacaagggctccttcgacatctggggccagggcaccatggtcaccgtctcctccgcctccaccaagggc

SEQ ID NO: 19846 - RNA, 405 nt, synthetic construct
  misc_feature 1..405: note = derived and/or modified sequence opt2 from anti-HIV_Chain
  source 1..405: mol_type = other RNA
cccctcgtccagctcgagccctccggcgtcgaggtcaagaagcgcggcgcctccgtcaaggtctcctgcaaggtctccggctactccctcaccgagctctccatgcactgggtccgccaggcccccggcaagggcctcgagtggatgggctccttcgaccccctcgacggcgacaccatctacgcccagaagttccagggccgcgtcaccatgaccgtcgacacctccaccgacaccgcctacatggacctctcctccctccgcttcgaggacaccgccgtctactactgcgccaccccctccaaggcctactactacgactcccccaactacgagggcgacttctacatggacgtctggggcaagggcaccaccgtcatcgtctcctccgcctccaccaagggc

SEQ ID NO: 19847 - RNA, 408 nt, synthetic construct
  misc_feature 1..408: note = derived and/or modified sequence opt2 from anti-HIV_HeavyChain
  source 1..408: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagctcacctccgacgacaccgccgtctacttctgcaccaccacctccacctacgacaagtggtccggcctccaccacgacggcgtcatggccttctcctcccgcggccagggcaccctcatctccgtctccgccgcctccaccaagggc

SEQ ID NO: 19848 - RNA, 408 nt, synthetic construct
  misc_feature 1..408: note = derived and/or modified sequence opt2 from anti-HIV_HeavyChain
  source 1..408: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagggcctcgagtacatcggccagatctggcgctggaagtcctccgcctcccaccacttccgcggccgcgtcctcatctccgccgtcgacctcaccggctcctccccccccatctcctccctcgagatcaaggtcacctccgacgacaccgccgtctacttctgcaccaccacctccacctacgacgagtggtccgacctccaccacgacggcgtcatggccttctcctcctggggccagggcaccctcatctccgtctccgccgcctccaccaagggc

SEQ ID NO: 19849 - RNA, 408 nt, synthetic construct
  misc_feature 1..408: note = derived and/or modified sequence opt2 from anti-HIV_HeavyChain
  source 1..408: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagctcacctccgacgacaccgccgtctacttctgcaccaccacctccacctacgaccgctggtccggcctccaccacgacggcgtcatggccttctcctcctggggccagggcaccctcatctccgtctccgccgcctccaccaagggc

SEQ ID NO: 19850 - RNA, 408 nt, synthetic construct
  misc_feature 1..408: note = derived and/or modified sequence opt2 from anti-HIV_Chain
  source 1..408: mol_type = other RNA
tgcaacccccgcgtccactccgaggtccagctcgtcgagtccggcgccgaggtcaagaagcccggcgcctccgtcaaggtcgcctgcaaggtctccggcaagaagctctccgacctctccatccactgggtccgccaggcccccggcaagggcctcgagtggatgggcggcttcgacgaggaggacggcaagatctcctacgagcgcaagttccagggccgcgtctccatgaccgaggacaccgcccgcgacaccgccttcatggagatgtcctccctccgctccgacgacaccgccgtctacttctgcgccgccgccccccgcctcgacctcggcgagctctcctccggcttccacttctggggcctcggcaccctcgtcaccgtctcctccgcctccaccaagggc

SEQ ID NO: 19851 - RNA, 408 nt, synthetic construct
  misc_feature 1..408: note = derived and/or modified sequence opt2 from anti-HIV_Chain
  source 1..408: mol_type = other RNA
atctgggcccccctcatcgccgtcaccttcctcgtcctccactgcgagtccctcggcacctgctgctgctgccaggcctccggcggcaccttcaacaccttcgccatcaactgggtccgccaggcccccggccagggcctcgagtgggtcggcggcatcatccccgtcttcggcaccgcctcctacgcccagaagttccagggccgcgtcaccgtcaccaccgacgagtcccgcggcaccgcctacatggagctcaactccctccgctccgaggacaccgccgtctactactgcgcccgcggccagaccgacctcaacgacgacctctggtccgactactccacccccggcttcgactactggggccagggcaccctcgtcaccgtctcctccgcctccaccaagggc

SEQ ID NO: 19852 - RNA, 408 nt, synthetic construct
  misc_feature 1..408: note = derived and/or modified sequence opt2 from anti-HIV_Chain
  source 1..408: mol_type = other RNA
ctccagccccgcgtccactccgaggtccagctcgtcgagtccggcgccgaggtcaagaagcccggcgcctccgtcaaggtctcctgcaaggtctccggctacaccctctccgacctctccatgcactgggtccgccaggcccccggcaagggcctcgagtggatgggcggcttcgacgaggaggacggcgagatcacctacgcccagaagttccagggccgcgtctccatgaccgaggacacctcccgcgacaccgcctacatggagctctcctccctccgctccgaggacaccgccgtctactactgcgccaccgccccccgcctcgagctcggcgagctctcctccggcttccactactggggcctcggcaccctcgtcaccgtctcctccgcctccaccaagggc

SEQ ID NO: 19853 - RNA, 408 nt, synthetic construct
  misc_feature 1..408: note = derived and/or modified sequence opt2 from anti-HIV_Chain
  source 1..408: mol_type = other RNA
cagtcccaggtccacctcgtccagtccggcgccgaggtcaagaagcccggctcctccgtcaaggtctcctgccaggcctccggcggcaccttcaacaccttcgccatcaactgggtccgccaggcccccggccagggcctcgagtgggtcggcggcatcatccccgtcttcggcaccgcctcctacgcccagaagttccagggccgcgtcaccgtcaccaccgacgagtcccgcggcaccgcctacatggagctcaactccctccgctccgaggacaccgccgtctactactgcgcccgcggccagaccgacctcaacgacgacctctggtccgactactccacccccggcttcgactactggggccagggcaccctcgtcaccgtctcctccgcctccaccaagggc

SEQ ID NO: 19854 - RNA, 408 nt, synthetic construct
  misc_feature 1..408: note = derived and/or modified sequence opt2 from anti-HIV_Chain
  source 1..408: mol_type = other RNA
ggctccgaggtccagctcgtcgagtccggcgccgaggtcaagaagcgcggcgcctccgtcaaggtctcctgcaaggtctccggctactccctcaccgagctctccatgcactgggtccgccaggcccccggcaagggcctcgagtggatgggctccttcgaccccctcgacggcgacaccatctacgcccagaagttccagggccgcgtcaccatgaccgtcgacacctccaccgacaccgcctacatggacctctcctccctccgcttcgaggacaccgccgtctactactgcgccaccccctccaaggcctactactacgactcccccaactacgagggcgacttctacatggacgtctggggcaagggcaccaccgtcatcgtctcctccgcctccaccaagggc

SEQ ID NO: 19855 - RNA, 408 nt, synthetic construct
  misc_feature 1..408: note = derived and/or modified sequence opt2 from anti-HIV_Chain
  source 1..408: mol_type = other RNA
caggtccagctcgtccagtccggcggcgaggtcaagaagcccggcgcctccgtcaaggtctcctgcaaggtctccggctactccctcaccgagctctccatgcactgggtccgccaggcccccggcaagggcctcgagtggatgggcgtcttcgaccccctcgagggcgacggcgtctacgtccagaagttccgcggccgcgtcatcatgaccgaggacacctccaccgacaccgcctacatggagctcacctccctccgctccgaggacaccgccatctactactgcgccaccaaggccaaggactactactacgagtcctccgactactccccctactactactactacatggacgtctggggcaagggcaccaccgtcaccgtctcctccgcctccaccaagggc

SEQ ID NO: 19856 - RNA, 408 nt, synthetic construct
  misc_feature 1..408: note = derived and/or modified sequence opt2 from anti-HIV_Chain
  source 1..408: mol_type = other RNA
gaggtccagctcgtccagtccggcgccgaggtcaagaagcccggcgcctccgtcaaggtctcctgcaaggtctccggctacaccctcaccgagctctccatgcactgggtccgccaggcccccggcaagggcctcgagtggatgggcgtcttcgaccccctcgagggcgacggcgtctacgccgagaagttccgcggccgcgtcatcatgaccgaggacacctccaccgacaccggctacatggagctcacctccctccgctccgaggacaccgccatctactactgcgccaccaaggccaaggactactactacgagtcctccgactactccccctactactactactacatggacgtctggggcaagggcaccaccgtcaccgtctcctccgcctccaccaagggc

SEQ ID NO: 19857 - RNA, 408 nt, synthetic construct
  misc_feature 1..408: note = derived and/or modified sequence opt2 from anti-HIV_Chain
  source 1..408: mol_type = other RNA
caggtccagctcgtccagtccggcgccgaggtcaagaagcccggcgcctccgtcaaggtctcctgcaaggcctccggctacaccttcacccgctaccacatccactgggtccgccacgcccccggccagggcctcgagtggatgggcaagatcaacccctcccgcgcctccaccaagtacgccaagaagttccaggaccgcgtcaccatgacccgcgacacctccacctccaccgtctacatggagctctcctccctccgcggcgacgacaccgccgtctactactgcggccgcgagatgggcaccttcaccctcctcggcgtcgtcatcgaccactacgacttctaccccatggacgtctggggccagggcacccccgtcaccgtctcctccgcctccaccaagggc

SEQ ID NO: 19858 - RNA, 408 nt, synthetic construct
  misc_feature 1..408: note = derived and/or modified sequence opt2 from anti-HIV_Chain
  source 1..408: mol_type = other RNA
tcccgccccccctcctgcctcctcggctgctggtgctgctccggcttcctcctccccgccgtcatcctccccaacctccactccccctgcctctccctcctcgagtcccagcccccctccctcgccgacctcgtctccgccttcgccgtcatggacatccccatctacatcggcacctaccgctcccaggcctccctccactcctcctccaccaagttccccaccgacttcctcggctcccagaccggctccgtcgccgtcggccagggccagatctcccacctccgctccgtcgagtggcgcctccgcatgtgggagttcatcaccgccctcaaggtccacatgttcctctcccgctccgaccgcggcccccgctggaagaacgtctcctccctcctcaactcccgc

SEQ ID NO: 19859 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcatcatctccgccgtcgacctcaccggctcctccccccccatctcccccctcgagatcaagaacctcacctccgacgacaccgccgtctacttctgcaccaccacctccacctccgaccgctggtccggcctccaccacgacggcgtcatggccttctcctcctggggccagggcaccctcatctccgtctccgccgcctccaccaagggc

SEQ ID NO: 19860 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcatcatctccgccgtcgacctcaccggctcctccccccccatctcctccctcgagatcaagaacctcacctccgacgacaccgccgtctacttctgcaccaccgcctccacctacgacaagtggtccggcctccaccacgacggcgtcatggccttctcctcctggggccagggcaccctcatctccgtctccgccgcctccaccaagggc

SEQ ID NO: 19861 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggcccctccccccccatctcctccctcgagatcaagaacctcacctccgacgacaccgccgtctacttctgcaccaccacctccacctacgacaagtggtccggcctccaccacgacggcgtcatggccttctcctcctggggccagggcaccctcatctccgtctccgccgcctccaccaagggc

SEQ ID NO: 19862 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcgccgtctcctgcaaggcctacggcgtcaacaccttcggcctctacgccgtcaactgggtccgccaggcccccggccagtccctcgagtacatcggccagatctggcgctggaagtcctccgcctcccacgacttccgcggccgcgtcatcatctccgccgtcgacctcaccggctcctccccccccatctcctccctcgagatcaagaacctcacctccgacgacaccgccgtctacttctgcaccgccacctccacccccgactactggtccggcctccaccacgacggcgtcatggccttctcctcctggggccagggcaccctcatctccgtctccgccgcctccaccaagggc

SEQ ID NO: 19863 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccggcgtcaagaagcccggctcctccgtcaccgtctcctgcaaggcctacggcgtcaacaccttcggcctctacgccgtcaactgggtccgccaggcccccggccagggcctcgagtacatcggccagatctggcgctggaagtcctccgcctcccaccacttccgcggccgcgtcctcatctccgccgtcgacctcaccggctcctccccccccatcacctccctcgagatcaagaacgtcacctccgacgacaccgccgtctacttctgcaccaccacctccacctacgacaagtggtccggcctctaccacgacggcgtcatggccttctcctcctggggccagggcaccctcatctccgtctccgccgcctccaccaagggc

SEQ ID NO: 19864 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcatcatctccgccgtcgacctcaccggctcctccccccccatctcctccctcgagatcaagaacctcacctccgacgacaccgccgtctacttctgcaccaccacctccacctccgactactggtccggcctccaccacgacggcgtcatggccttctcctcctggggccagggcaccctcatctccgtctccgccgcctccaccaagggc

SEQ ID NO: 19865 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgaccgctggtccggcctccaccacgacggcgtcatggccttctcctcctggggccagggcaccctcatctccgtctccgccgcctccaccaagggc

SEQ ID NO: 19866 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtccgcaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgacaagtggtccggcctccaccacgacggcgtcatggccttctcctcctggggccagggcaccctcatctccgtctccgccgcctccaccaagggc

SEQ ID NO: 19867 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgaccagtggtccggcctccaccacgacggcgtcatggccttctcctcctggggccagggcaccctcatctccgtctccgccgcctccaccaagggc

SEQ ID NO: 19868 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtctcctgggtccgccaggcccccggccagcgcctcgagtacatcggccagatccgccgctggaagtcctccgcctcccaccacttccgcggccgcgtcaccgtctccgccgtcgaccccaccggctcctccccccccatctcctccctcgagatccgcgacctcaccaccgacgacaccgccgtctacttctgcaccaccacctccacctccgactactggtccggcctccacaacgagcgcggcaccgccttctcctcctggggccagggcaccctcatctccgtctccgccgcctccaccaagggc

SEQ ID NO: 19869 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagggcctcgagtacatcggccagatctggcgctggaagtcctccgcctcccaccacttccgcggccgcgtcctcatctccgccatcgacctcaccggctcctccccccccatctcctccctcgagatcaagaacgtcacctccgacgacaccgccgtctacttctgcaccaccatgtccacctacgacaagtggtccggcctccaccacgacggcgtcatggccttctcctcctggggccagggcaccctcatctccgtctccgccgcctccaccaagggc

SEQ ID NO: 19870 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacgaggtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacgtcacctccgacgacaccgccgtctacttctgcaccaccacctccacccacgacaagtggtccggcctccaccacgacggcgtcatggccttctcctcctggggccagggcaccctcatctccgtctccgccgcctccaccaagggc

SEQ ID NO: 19871 - RNA, 411 nt, synthetic construct
  misc_feature 1..411: note = derived and/or modified sequence opt2 from anti-HIV_HeavyChain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagggcctcgagtacatcggccagatctggcgctggaagtcctccgcctcccaccacttccgcggccgcgtcctcatctccgccgtcgacctcaccggctcctccccccccatctcctccctcgagatcaagaacgtcacctccgacgacaccgccgtctacttctgcaccaccacctccacctacgacaagtggtccggcctccaccacgacggcgtcgtcgccttctcctcctggggccagggcaccctcatctccgtctccgccgcctccaccaagggc

SEQ ID NO: 19872 - RNA, 411 nt, synthetic construct
  misc_feature 1..411: note = derived and/or modified sequence opt2 from anti-HIV_Chain
  source 1..411: mol_type = other RNA
caggtcaccctcgtccagtccggcgccgaggtcaagaagcccggcgcctccgtccgcatctcctgccgcgcctccggcttcaccttcgacgactactccgactactccttcatccccaccacctacctcatccactggttccgccaggcccccggccagggcctcgagtggatggcctggatcaactccgtcaacggcggccgcaacatcgcccgccagttccagggccgcgtcaccgtcgcccgcgaccgctccaactccatcgccttcctcgagttctccggcctccgccacgacgacaccgccgtctacttctgcgcccgcgaccgccgcgacgacgaccgcgcctggctcctcgacccctggggccagggcacccgcgtcaccgtctcctccgcctccaccaagggc

SEQ ID NO: 19873 - RNA, 411 nt, synthetic construct
  misc_feature 1..411: note = derived and/or modified sequence opt2 from anti-HIV_Chain
  source 1..411: mol_type = other RNA
cagatccacctcgtccagtccggcaccgaggtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgacaagtggtccggcctccaccacgacggcgtcatggccttctcctcctggggccagggcaccctcatctccgtctccgccgcctccaccaagggc

SEQ ID NO: 19874 - RNA, 414 nt, synthetic construct
  misc_feature 1..414: note = derived and/or modified sequence opt2 from anti-HIV_Chain
  source 1..414: mol_type = other RNA
gtcgtccagctcgtccagtccggcgccgaggtccgcaagcccggctcctccctcaaggtctcctgcaagtcctccggcggcaccttctcccgcttcgtcgtcaactgggtccgccaggcccccggccagggcctcgagtggatgggcggcatgatccccatcttcggcatcgccaagtacgcccagaagttccaggaccgcgtcaccatgaccgccgacgagtccaagaacaccgtctacctcgacttctcctccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19875 - RNA, 414 nt, synthetic construct
  misc_feature 1..414: note = derived and/or modified sequence opt2 from anti-HIV_Chain
  source 1..414: mol_type = other RNA
caggtccagctcgtccagtccggcgccgaggtccgcaagcccggctcctccctcaaggtctcctgcaagtcctccggcggcaccttctcccgcttcgtcgtcaactgggtccgccaggcccccggccagggcctcgagtggatgggcggcatgatccccatcttcggcatcgccaagtacgcccagaagttccaggaccgcgtcaccatgaccgccgacgagtccaagaacaccgtctacctcgacttctcctccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19876 - RNA, 414 nt, synthetic construct
  misc_feature 1..414: note = derived and/or modified sequence opt2 from anti-HIV_Chain
  source 1..414: mol_type = other RNA
gaggtccagctcgtcgagtccggcgccgaggtccgcaagcccggctcctccctcaaggtctcctgcaagtcctccggcggcaccttctcccgcttcgtcgtcaactgggtccgccaggcccccggccagggcctcgagtggatgggcggcatgatccccatcttcggcatcgccaagtacgcccagaagttccaggaccgcgtcaccatgaccgccgacgagtccaagaacaccgtctacctcgacttctcctccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19877 - RNA, 414 nt, synthetic construct
  misc_feature 1..414: note = derived and/or modified sequence opt2 from anti-HIV_Chain
  source 1..414: mol_type = other RNA
caggtccagctcgtcgagtccggcgccgaggtccgcaagcccggctcctccctcaaggtctcctgcaagtcctccggcggcaccttctcccgctacgtcgtcaactgggtccgccaggcccccggccagggcctcgagtggatgggcggcatcatccccatcttcggcatcgccaagtacgcccagaagttccaggaccgcgtcaccatgaccgccgacgagcccaagaacaccgtctacctcgacttcaactccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19878 - RNA, 414 nt, synthetic construct
  misc_feature 1..414: note = derived and/or modified sequence opt2 from anti-HIV_Chain
  source 1..414: mol_type = other RNA
caggtccagctcgtccagtccggcgccgaggtccgcaagcccggctcctccctcaaggtctcctgcaagtcctccggcggcaccttctcccgctacgtcgtcaactgggtccgccaggcccccggccagggcctcgagtggatgggcggcatgatccccatcttcggcatcgccaagtacgcccagaagttccaggaccgcgtcaccatgaccgccgacgagtccaagaacaccgtctacctcgacttctcctccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19879 - RNA, 414 nt, synthetic construct
  misc_feature 1..414: note = derived and/or modified sequence opt2 from anti-HIV_Chain
  source 1..414: mol_type = other RNA
caggtccagctcgtccagtccggcgccgaggtccgcaagcccggctcctccctcaaggtctcctgcaagtcctccggcggcaccttctcccgctacgtcgtcaactgggtccgccaggcccccggccagggcctcgagtggatgggcggcatcatccccatcttcggcatcgccaagtacgcccagaagttccaggaccgcgtcaccatgaccgccgacgagtccaagaacaccgtctacctcgacttctcctccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19880 - RNA, 414 nt, synthetic construct
  misc_feature 1..414: note = derived and/or modified sequence opt2 from anti-HIV_Chain
  source 1..414: mol_type = other RNA
caggtccagctcgtcgagtccggcgccgaggtccgcaagcccggctcctccctcaaggtctcctgcaagtcctccggcggcaccttctcccgctacgtcgtcaactgggtccgccaggcccccggccagggcctcgagtggatgggcggcatcatccccatcttcggcatcgccaagtacgcccagaagttccaggaccgcgtcaccatgaccgccgacgagtccaagaacaccgtctacctcgacttctcctccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19881 - RNA, 414 nt, synthetic construct
  misc_feature 1..414: note = derived and/or modified sequence opt2 from anti-HIV_Chain
  source 1..414: mol_type = other RNA
caggtccagctcgtccagtccggcgccgaggtccgcaagcccggctcctccctcaaggtctcctgcaagtcctccggcggcaccttctcccgctacgtcgtcaactgggtccgccaggcccccggccagggcctcgagtggatgggcggcatcatccccatcttcggcatcgccaagtacgcccagaagttccaggaccgcgtcaccatgaccgccgacgagcccaagaacaccgtctacctcgacttcaactccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19882 - RNA, 414 nt, synthetic construct
  misc_feature 1..414: note = derived and/or modified sequence opt2 from anti-HIV_Chain
  source 1..414: mol_type = other RNA
gtcgtccagctcgtccagtccggcgccgaggtccgcaagcccggctcctccctcaaggtctcctgcaagtcctccggcggcaccttctcccgctacgtcgtcaactgggtccgccaggcccccggccagggcctcgagtggatgggcggcatgatccccatcttcggcatcgccaagtacgcccagaagttccaggaccgcgtcaccatgaccgccgacgagtccaagaacaccgtctacctcgacttctcctccctccgctccgacgacaccgccgtctactactgcgcccgcgaccgcggcgacacccgcctcctcgactacggcgactacgaggacgagcgctactactacggcatggacgtctggggccagggcaccaccgtcatcgtctcctccgcctccaccaagggc

SEQ ID NO: 19883 - RNA, 414 nt, synthetic construct
  misc_feature 1..414: note = derived and/or modified sequence opt2 from anti-HIV_Chain
  source 1..414: mol_type = other RNA
ttcatctgcttctccgtcgtcgtccgcctcctcgagttcggcggccgcctcgtccagcccggcggctccctccgcctctcctgctccgcctccggcttcaccttctccaactccgccatgtcctgggtccgccaggcccccggcaagggcctcgagtgggtctcctccatcctctcctccggcgtcggcaccttctacgccgactccgtcaagggccgcttcaccgtctcccgcgacaactcccgcaacaccctctacctccagatgaagtccctccgcgccgaggacaccgccctctactactgcgccaaggtccagatccagcagctcaacttcggcgtcatcaccgacgccggcctcgacgtctggggcaagggcaccaccctcatcgtctcctccgcctccaccaagggc

SEQ ID NO: 19884 - RNA, 414 nt, synthetic construct
  misc_feature 1..414: note = derived and/or modified sequence opt2 from anti-HIV_Chain
  source 1..414: mol_type = other RNA
caggtccagctcgtccagtccggcgccgaggtccgcaagcccggctcctccctcaaggtctcctgcaagtcctccggcggcaccttctcccgctacgtcgtcaactgggtccgccaggcccccggccagggcctcgagtggatgggcggcatcatccccatcttcggcatcgccaagtacgcccagaagttccaggaccgcgtcaccatgaccgccgacgagtccaagaacaccgtctacctcgacttctcctccctccgctccggcgacaccgccgtctactactgcgcccgcgaccgcggcgacacccgcctcctcgactacggcgactacgaggacgagcgctactactacggcatggacgtctggggccagggcaccaccgtcaccgtctcctccgcctccaccaagggc

SEQ ID NO: 19885 - RNA, 417 nt, synthetic construct
  misc_feature 1..417: note = derived and/or modified sequence opt2 from anti-HIV_Chain
  source 1..417: mol_type = other RNA
caggtccagctcgtcgagtccggcgccgaggtcaagaagcccggctcctccgtcaaggtctcctgcaaggcctccggcggcaccttcaacatcttcgccttctcctgggtccgccaggcccccggccagggcctcgagtggatgggcggcatcatccccatcttcgcctcccccaactacgcccagcgcttccagggccgcgtcaccatcaccgccgacgagtccacctccaccgtccacatggagctctcctccctccgctccgaggacaccgccatctactactgcgccaaggacgcccacatgcacatcgaggagccccgcgactacgactacatctggggcacctccccctactacttcgactactggggccagggcaccctcgtcaccgtctcctccgcctccaccaagggc

SEQ ID NO: 19886 - RNA, 417 nt, synthetic construct
  misc_feature 1..417: note = derived and/or modified sequence opt2 from anti-HIV_Chain
  source 1..417: mol_type = other RNA
caggtccagctcgtcgagtccggcgccgaggtcaagaagcccggcgcctccgtcaaggtctcctgcaaggcctccggctacaccttcacctcccacgacatcaactgggtccgccaggccaccggccagggcctcgagtggatgggctggatgaaccccaactccggcgacaccggctacgcccacaagttccagggccgcgtcaccatgacccgcaacacccccatctccaccgcctacatggagctctcctccctccgctccgaggacaccgccgtctactactgcgcccgcggccgcgccacctcccgcaacaccccctgggcccactactacgactcctccggctactacggcgccggcgactactggggccagggcaccctcgtcaccgtctcctccgcctccaccaagggc

SEQ ID NO: 19887 - RNA, 417 nt, synthetic construct
  misc_feature 1..417: note = derived and/or modified sequence opt2 from anti-HIV_Chain
  source 1..417: mol_type = other RNA
caggtccagatccgccagtccggccccggcctcgtcaagcccctcgagaccctctccctctcctgcatcgtcttcggcggctccttcatcgcctaccactggacctggatccgccaggcccccctcaagggcctcgagtggatcggcgacatcgaccagggcggcgacatcacctactccccctccctcaagtcccgcgtcaccatgtccgtcgaccgctccaagtcccagttctccctcaagctctcctccgtcaccgccgccgacgccgccgtctactactgcgtccgcggcccccccaaccgctacgccgtcacctccttcacctccggcacccaccgcgagcgctcctcctactacttcgactactggggccccggcaccctcgtcaccgtctcctccgcctccaccaagggc

SEQ ID NO: 19888 - RNA, 423 nt, synthetic construct
  misc_feature 1..423: note = derived and/or modified sequence opt2 from anti-HIV_Chain
  source 1..423: mol_type = other RNA
aacggcggctccctccgcctctcctgccgcgtctccggcttcggcttccacctctacgagatgaactgggtccgccaggcccccggcaagggcctcgagtggatctcctccatctccggctccggcgagtccacccactactccgactccatcaccggccgcttctccatgtcccgcgacgaggccaaggactccctctacctccagatgaacaacctccgcgtcgaggacaccgccgtctactactgcacccgcggcttctccatgggcgacggcaccggcttctccttcgacacctggggccgcggcaccatggtcaccgtctcctccggcctcgacaccgtctccctcgcctccaccaagggcccctccgtcttccccctcgccccctgctcccgctccacctccgacgcccgcctctcc

SEQ ID NO: 19889 - RNA, 423 nt, synthetic construct
  misc_feature 1..423: note = derived and/or modified sequence opt2 from anti-HIV_Chain
  source 1..423: mol_type = other RNA
caggtccagctcgtccagtccggcgccgaggtcaagaagcccggctcctccgtcaaggtctcctgcaaggcctccggcggcaccttctccacctacgccatctcctgggtccgccaggcccccggccagggcctcgagtggatgggcggcatcatcccctccttctccatgtccaactacgcccaggacttccagggccgcctcaccatcaccgccgacgagtccacctcctccgtctacatggagctcaactccctccgctccgaggacaccgccgtctactactgcgcccgcgacttcccccgcttccaccgcctcgtcggcaactacgacttctggcgcggcaccctcgaccgcttctcctacatggacctctggggccgcggcaccgccgtcaccgtctcctccgcctccaccaagggc

SEQ ID NO: 19890 - RNA, 423 nt, synthetic construct
  misc_feature 1..423: note = derived and/or modified sequence opt2 from anti-HIV_Chain
  source 1..423: mol_type = other RNA
ctcgtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccgtcatctcctacgacggctccaacaagttctacgccgactccgtcaagggccgcttcaccatctcccgcgacaactccaagaacaccctctacctccagatgaactccctccgcgccgaggacaccgccgtctactactgcgcccgccccaagttcctccccggcgccgacatcgtcgtcgtcgtcgccgccacccccttcgactactggggccagggcaaccccggccaccgcctcctctccttccaccagggccccatcggcctcccccccggc

SEQ ID NO: 19891 - RNA, 423 nt, synthetic construct
  misc_feature 1..423: note = derived and/or modified sequence opt2 from anti-HIV_HeavyChain
  source 1..423: mol_type = other RNA
atggagtggtccggcgtcttcatcttcctcctctccgtcaccgccggcgtccactccgaggtccagctcgtcgagtccggcggcggcctcgtcaagcccggcggctccctccgcctctcctgcgccgcctccggctacaccttctccaactactggatcggctgggtccgccaggcccccggcaagggcctcgagtggatcggcgacatctaccccggcggcaactacatccgcaacaacgagaagttcaaggacaagaccaccctctccgccgacacctccaagaacaccgcctacctccagatgaactccctcaagaccgaggacaccgccgtctactactgcggctcctccttcggctccaactacgtcttcgcctggttcacctactggggccagggcaccctcgtcaccgtctcctcc

SEQ ID NO: 19892 - RNA, 423 nt, synthetic construct
  misc_feature 1..423: note = derived and/or modified sequence opt2 from anti-HIV_HeavyChain
  source 1..423: mol_type = other RNA
atggagtggtccggcgtcttcatcttcctcctctccgtcaccgccggcgtccactcccaggtccagctcgtccagtccggccccgacgtcaagaagcccggcacctccatgaagatgtcctgcaagacctccggctacaccttctccaactactggatcggctgggtccgccaggcccccggccagggcctcgagtggatcggcgacatctaccccggcggcaactacatccgcaacaacgagaagttcaaggacaagaccaccctcaccgccgacacctccacctccaccgcctacatgcagctcggctccctccgctccgaggacaccgccgtctactactgcggctcctccttcggctccaactacgtcttcgcctggttcacctactggggccagggcaccctcgtcaccgtctcctcc

SEQ ID NO: 19893 - RNA, 429 nt, synthetic construct
  misc_feature 1..429: note = derived and/or modified sequence opt2 from anti-HIV_Chain
  source 1..429: mol_type = other RNA
caggtcttcgtccagctcgtccagtccggcggcggcctcgtccagcccggcggctccgtccgcctctcctgcaccgcctccggcttcctcttctccacctactccatgaactgggtccgccaggcccccggcaagggcctcgagtgggtctcctccatctccaccacctccaactacatctactacgccgactccgtcaagggccgcttcaccatctcccgctccaacggccagggctccctctacctccagctcaactccctccgcgtcgaggacaccgccgtctactactgcgcccgcgacaccaaggtcggcgccccccgccaggactgctacgccatggacctctggggccagcgcgaccacggccaccgcctcctctccttccaccagggccccatcggcctcccccccggcgccctcctccag

SEQ ID NO: 19894 - RNA, 432 nt, synthetic construct
  misc_feature 1..432: note = derived and/or modified sequence opt2 from anti-HIV_Chain
  source 1..432: mol_type = other RNA
atcatcctcttcctcgtcgccaccgccaccggcgtccactccgacatccagatgacccagtccccctcctccctctccgcctccgtcggcgaccgcgtcaccatcacctgccgcgcctcccagtccatcgaccgctacctcaactggtaccagcacaagcccggcaaggcccccaagctcctcatctacgccgcctccaacctccacaccgacgtcccctcccgcttctccggctccggcgccggcacctacttcaccctcaccatcacctccctccagcccgaggacttcgccacctactactgccagcagtcccactccccctccttcggccaggagtcctactccatcgccttcggccagggcacccgcctcgagatcaagcgcaccgtcgccgccccctccgtcttcatcttccccccctccgacgag

SEQ ID NO: 19895 - RNA, 432 nt, synthetic construct
  misc_feature 1..432: note = derived and/or modified sequence opt2 from anti-HIV_Chain
  source 1..432: mol_type = other RNA
ctccagcagctccaggtcccccgcctctccatgtggcgcgtcttcaaggtcgccgccgccaccggcgcccagaccctcaccgtcgaggagcccggctcctccgtcaaggtctcctgcaaggcctccggcggctcctccaccgcctacggctactcctgggtccgccaggcccccggccagggcttcgagtggatgggccgcatcatccccttctacggcatcatcacctacgcccccaagttccagggccgcgtcaccatcaccgccgaccgctccacctccaccgtctacatggagctcacctccctcaccttcgccgacaccgccctcttcttctgcgcccgcgacttcggcgacccccgcaacggctactacttcgactcctgggaccagggcctctggctcaccgtctcctccgcctccaccaagggc

SEQ ID NO: 19896 - RNA, 432 nt, synthetic construct
  misc_feature 1..432: note = derived and/or modified sequence opt2 from anti-HIV_Chain
  source 1..432: mol_type = other RNA
caggtccgcctcgagcagtccggcgtcgccatgcgcaagcccggcgcctccgtcaccctctcctgccaggcctccggctacaacttcgtcaagtacatcatccactgggtccgccagaagcccggcctcggcttcgagtgggtcggcatgatcgacccctaccgcggccgcccctggtccgcccacaagttccagggccgcctctccctctcccgcgacacctccatggagatcctctacatgaccctcacctccctcaagtccgacgacaccgccacctacttctgcgcccgcgccgaggccgcctccgacatccactcccgccccatcatcctcaccggccccggcgagtacggcctcgacctcgagcacatggactggacctggcgcatcctctgcctcctcgccgtcgcccccggctgccactcccag

SEQ ID NO: 19897 - RNA, 435 nt, synthetic construct
  misc_feature 1..435: note = derived and/or modified sequence opt2 from anti-HIV_Chain
  source 1..435: mol_type = other RNA
atgttcctcttcctcgtcgccggcgccaccggcgtccagtcccaggtctacctcgtccccttcggccccgaggtcaagaagcccggctcctccgtcaaggtctcctgcaaggcctccggcgactccttcacctcctccgtcatcacctgggtccgccaggcccccggccagggccccgagtggatgggccgcgtcatccccgtcctcggcgtcgccgcctacgcccagaagttctacggccgcgtcaccatcaccgccgacacctcctccaacaccgcctacatggaggtcaactccctccgcttcgaggacaccgccgtctactactgcgcccgcgagaccggccgcggcggcaacctcgccctccgccagtacttcttcgactcctggggccagggcaccctcgtcaccgtctcctccccctccaccaagggc

SEQ ID NO: 19898 - RNA, 438 nt, synthetic construct
  misc_feature 1..438: note = derived and/or modified sequence opt2 from anti-HIV_Chain
  source 1..438: mol_type = other RNA
caggtccagctccaggagtccggccccggcctcgtcaagccctccggcaccctctccctcacctgcgccgtctccggcgcctccatctcctcccgcaactggtggacctgggtccgccagccccccggcaagggcctcgagtggatcggcgagatctacgagtccggcgccaccaactacaacccctccctcaagtcccgcgtcaccatctccgtcgacaagtccaagaaccagttctccctccgcctcacctccgtcaccgccgccgacaccgccgtctacttctgcgcccgcctcatgaccttcggcggcctcatcggcaccctcgactactggggccagggcaccctcgtcaccgtcctccagccccccccccgcgcccaccgctaccacccccgcaacctcctccaggagcacctctgcgcccgcgtcatgccc

SEQ ID NO: 19899 - RNA, 444 nt, synthetic construct
  misc_feature 1..444: note = derived and/or modified sequence opt2 from anti-HIV_HeavyChain
  source 1..444: mol_type = other RNA
atggagtggtccggcgtcttcatcttcctcctctccgtcaccgccggcgtccactccgaggtccagctcgtcgagtccggcggcggcctcgtcaagcccggcggctccctccgcctctcctgcgccgcctccggctacaccttctccaactactggatcggctgggtccgccaggcccccggcaagggcctcgagtggatcggcgacatctaccccggcggcaactacatccgcaacaacgagaagttcaaggacaagaccaccctctccgccgacacctccaagaacaccgcctacctccagatgaactccctcaagaccgaggacaccgccgtctactactgcggctcctccttcggctccaactacgtcttcgcctggttcacctactggggccagggcaccctcgtcaccgtctcctccggcgagtccctcaagcccctc

SEQ ID NO: 19900 - RNA, 444 nt, synthetic construct
  misc_feature 1..444: note = derived and/or modified sequence opt2 from anti-HIV_HeavyChain
  source 1..444: mol_type = other RNA
atggagtggtccggcgtcttcatcttcctcctctccgtcaccgccggcgtccactcccaggtccagctcgtccagtccggccccgacgtcaagaagcccggcacctccatgaagatgtcctgcaagacctccggctacaccttctccaactactggatcggctgggtccgccaggcccccggccagggcctcgagtggatcggcgacatctaccccggcggcaactacatccgcaacaacgagaagttcaaggacaagaccaccctcaccgccgacacctccacctccaccgcctacatgcagctcggctccctccgctccgaggacaccgccgtctactactgcggctcctccttcggctccaactacgtcttcgcctggttcacctactggggccagggcaccctcgtcaccgtctcctccggcgagtccctcaagcccctc

SEQ ID NO: 19901 - RNA, 447 nt, synthetic construct
  misc_feature 1..447: note = derived and/or modified sequence opt2 from anti-HIV_Chain
  source 1..447: mol_type = other RNA
caggcccgcctcgaccagtggggcaccggcctcctcaagccctccgagaccctctccctcaagtgcgccgtcttcggcgtcctcttcaccgactacaactggacctgggtccgccagtcccccggcaagggcctcgagtggatcggccacctcgaccaccgcggcggcggcaactacaacccctccctcgagtcccgcgtcaccatctccctcgactactccaaggcccagttctccctccacctcaagtccgtcaccgtcgccgacaccgccctctactactgcgccggcgccgtcaagggcttctggttcgacgaggtctacaactggttcggccccggcgtccgcgagccctggctcccctccccccagccccccccccgcgcccaccgctcctccccctggcacccccccccccgcgcccccctcgtcaccgccaccgtcccc

SEQ ID NO: 19902 - RNA, 447 nt, synthetic construct
  misc_feature 1..447: note = derived and/or modified sequence opt2 from anti-HIV_Chain
  source 1..447: mol_type = other RNA
caggcccgcctcgaccagtggggcaccggcctcctcaagccctccgagaccctctccctcaagtgcgccgtcttcggcgtcctcttcaccgactacaactggacctgggtccgccagtcccccggcaagggcctcgagtggatcggccacctcgaccaccgcggcggcggcaactacaacccctccctcgagtcccgcgtcaccatctccctcgactactccaaggcccagttctccctccacctcaagtccgtcaccgtcgccgacaccgccctctactactgcgccggcgccgtcaagggcctctggttcgacgagacctacacctggttcggcccctggtcccagggcacccgcgtcaccgtcgcctccgcctccaccaagggcccctccgtcttccccctcgccccctcctccaagtccacctccggcacccgcgacctctcc

SEQ ID NO: 19903 - RNA, 447 nt, synthetic construct
  misc_feature 1..447: note = derived and/or modified sequence opt2 from anti-HIV_Chain
  source 1..447: mol_type = other RNA
gccgcccgcctcgaccagtggggcaccggcctcgtcaagccctccgagaccctctccctcaagtgcgccgtcttcggcgtcgacttccccgactacacctggacctgggcccgccaggcccccggcaagggcctcgagtggatcggccaccgcgaccaccgcggcggctcctcctacaacccctccctctccggccgcgccaccatctccctcgacacctccaaggcccagttctccctccacatcaagtccgtcaccgtcgccgacaccgccacctactactgcgccggcgccgtcgccggcctctggttcgaggacgcctacaactggttcggcccctggtcccagggcaccctcgtcaccgtcgccgccgcctccaccaagggcccctccgtcttccccctcgccccctcctccaagtccacctccggccacgcctccgtcctc

SEQ ID NO: 19904 - RNA, 450 nt, synthetic construct
  misc_feature 1..450: note = derived and/or modified sequence opt2 from anti-HIV_Chain
  source 1..450: mol_type = other RNA
ctcgcccagctcgagcagtccggcggcggcgtcgtcaagcccggcggctccctccgcctcccctgcgccgcctccggcttcaccttcatcgactactacatggcctggatccgcctcgcccccggcaagggcctcgagtggctctcctacatctccaagaacggcgactacaccaagtactccgagtccctcaagggccgcttcaccatctcccgcgacaacgccaagaacctcgtcatcctccagctcaaccgcctccgcgccgacgacaccgccatctacttctgcgcccgcgccgacggcctcacctacttcggcgagctcctccagtacatcttcgacctctggggccagggcgcccgcgtcatcgtctcctccgcctccaccaagggcccctccgtcttccccctcgccccctcctccaagtccacctccggccacgcctccgtc

SEQ ID NO: 19905 - RNA, 459 nt, synthetic construct
  misc_feature 1..459: note = derived and/or modified sequence opt2 from anti-HIV_Chain
  source 1..459: mol_type = other RNA
caggtccagctcgtccagtccggcgccgaggtcaagaagcccggcgcctccgtcaaggtctcctgcaaggtctccggctacaccctcaccgagctctccatccactgggtccgccaggcccccggcaagggcctcgagtggatgggcggcttcgactccgaggacggcgaggccatctacaagcagaacttccagggccgcgtcaccatgaccgaggacacctccaccgacaccgcctacatggagctctcccgcctccgctccgaggacaccgccgtctactactgcgccaccgccgaccgcttcaaggtcgcccaggacgagggcctcttcgtcatcttcgactactggggccagggcaaccccggccaccgcctcctctccctccaccagggccccatcggcctcccccccggcaccctcccccccaaggccacctccggccacgccgcccgccgc

SEQ ID NO: 19906 - RNA, 462 nt, synthetic construct
  misc_feature 1..462: note = derived and/or modified sequence opt2 from anti-HIV_Chain
  source 1..462: mol_type = other RNA
ctcgtccagctcgtccagtccggcgccgaggtcaagaagcccggcgcctccgtcaaggtctcctgcaaggtctccggctactccctcaccgagctctccatccactgggtccgccaggcccccggcaagggcctcgagtggatgggcggcttcgactccgaggacggcgaggccatctacaagcagaacttccagggccgcgtcaccatgaccgaggacacctccaccgacaccgcctacatggagctctcccgcctccgctccgaggacaccgccgtctactactgcgccaccgccgaccccttcaaggtcgcccaggacgagggcctcttcgtcatcttcgactactggggccagggcaccaccggccaccgcctcctctccctccaccagggcccccaccgcctctactccctcggcaccctcctctcccgcgcccccatcgtccagacccacatggcc

SEQ ID NO: 19907 - RNA, 471 nt, synthetic construct
  misc_feature 1..471: note = derived and/or modified sequence opt2 from anti-HIV_Chain
  source 1..471: mol_type = other RNA
cagatccacctcgtccagtccggcaccgacgtcaagaagcccggctcctccgtcaccgtctcctgcaaggcctacggcgtcaacaccttcggcctctacgccgtcaactgggtccgccaggcccccggccagtccctcgagtacatcggccagatctggcgctggaagtcctccgcctcccaccacttccgcggccgcgtcctcatctccgccgtcgacctcaccggctcctccccccccatctcctccctcgagatcaagaacctcacctccgacgacaccgccgtctacttctgcaccaccacctccacctacgaccagtggtccggcctccaccacgacggcgtcatggccttctcctcccgcggccagggcaccctcatctccgtctccgccgcctccaccaagggcccctccgtcttccccctcgccccctcctccaagtccacctacggcctcgcccacgtcctc

SEQ ID NO: 19908 - RNA, 477 nt, synthetic construct
  misc_feature 1..477: note = derived and/or modified sequence opt2 from anti-HIV_Chain
  source 1..477: mol_type = other RNA
cagcaccagctcgtcccctgcgtcgccgaggtccgcaagcccggcgcctccgtcaaggtctcctgcaaggtctccggctacaccctcaccgagatctccatgcactgggtccgccaggcccccggcaagggcctcgagtggatgggcggcttcgaccgcgaggacggcgagaccatctacgcccagaagttccagggccgcgtcaccatgaccgaggacacctccaccgacaccgcctacatggagctctcctccctccgctccgaggacaccgccgtctactactgcgccaccacctacctcgccgtcgtccccgacggcttcgacggctactcctcctcctggtactggttcgacccctggggccagggcaccctcgtcaccgtctcctccgcctccatgcagggccccatgctcctctcccccaccggcaccctcctcccccgcgcccccctcgtccagacccgccccggcccc

SEQ ID NO: 19909 - RNA, 642 nt, synthetic construct
  misc_feature 1..642: note = derived and/or modified sequence opt2 from anti-HIV_LightChain
  source 1..642: mol_type = other RNA
gacatcgtcatcacccagtccaccaagttcatgtccacctccgtcggcgaccgcgtctccatcacctgcaaggcctcccaggacgtctccaccgccgtcgcctggtaccagcagaagcccggccagtcccccaagctcctcatctactgggcctccacccgccacaccggcgtccccgaccgcttcaccggctccggctccggcaccgactacaccctcaccatctcccgcgtccaggccgaggacctcgccctctactactgccagcagcactacaccaccccctggaccttcggcggcggcaccaagctcgagatcaagcgcaccgtcgccgccccctccttcgtcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 19910 - RNA, 651 nt, synthetic construct
  misc_feature 1..651: note = derived and/or modified sequence opt2 from anti-HIV_Chain
  source 1..651: mol_type = other RNA
cagtccgtcctcacccagcccccctccgtctccgccgcccccggccagaaggtcaccatctcctgctccggctcctcctccaacatcggcaacaactacgtcctctggtaccagcagttccccggcaccgcccccaagctcctcatctacggcaacaacaagcgcccctccggcatccccgaccgcttctccggctccaagtccggcacctccgccaccctcggcatcaccggcctccagaccggcgacgaggccgactacttctgcgccacctgggactccggcctctccgccgactgggtcttcggcggcggcaccaagctcaccgtcctctcccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 19911 - RNA, 657 nt, synthetic construct
  misc_feature 1..657: note = derived and/or modified sequence opt2 from anti-HIV_Chain
  source 1..657: mol_type = other RNA
gacatcgtcatgacccagtcccccgactccctcgccgtctccctcggcgagcgcgtcaccatgaactgcaagtcctcccagtccctcctctactccaccaaccagaagaactacctcgcctggtaccagcagaagcccggccagtcccccaagctcctcatctactgggccaactccaccgagtccggcgtccccgaccgcttctccggctccggctccggcaccgacttcaccctcaccatctcctccgtccaggccgaggacgtcgccgtctactactgccagcagtactactcctaccgcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 19912 - RNA, 753 nt, synthetic construct
  misc_feature 1..753: note = derived and/or modified sequence opt2 from anti-HIV_SingleChain
  source 1..753: mol_type = other RNA
atgcaggtccagctcgagcagtccggcgccgaggtcaagaagcccggcgcctccgtcaaggtctcctgccaggcctccggctaccgcttctccaacttcaccgtccactgggtccgccaggcccccggccagcgcttcgagtggatgggctggatcaacccctacaacggcaacaaggagttctccgccaagttccaggaccgcgtcaccttcaccgccgacacctccgccaacaccgcctacatggagctccgctccctccgctccgccgacaccgccgtctactactgcgcccgcgtcggcgagtggggctgggacgactccccccaggacaactactacatggacgtctggggcaagggcaccaccgtcatcgtctcctccggcggcggcggctccggcggcggcggctccggcggcggcggctccgacatcgagctcacccagtcccccggcaccctctccctctcccccggcgagcgcgccaccttctcctgccgctcctcccactccatccgctcccgccgcgtcgcctggtaccagcacaagcccggccaggccccccgcctcgtcatccacggcgtctccaaccgcgcctccggcatctccgaccgcttctccggctccggctccggcaccgacttcaccctcaccatcacccgcgtcgagcccgaggacttcgccctctactactgccaggtctacggcgcctcctcctacaccttcggccagggcaccaagctcgagcgcaag

SEQ ID NO: 19913 - RNA, 1338 nt, synthetic construct
  misc_feature 1..1338: note = derived and/or modified sequence opt2 from anti-HIV_LightChain
  source 1..1338: mol_type = other RNA
gaggtcaagctcgaggagtccggcggcggcctcgtccagcccggcggctcccgcaagctctcctgcgccgcctccggcttcaccttctcctccttcggcatgcactgggtccgccaggcccccgagaagggcctcgagtgggtcgcctacatctcctccggctcctccaccctccactacgccgacaccgtcaagggccgcttcaccatctcccgcgacaaccccaagaacaccctcttcctccagatgaagctcccctccctctgctacggcctcctcggctcccgcaacctctcccaccgcctcctctcccagaacgacacccccatctgcctcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 19914 - RNA, 1380 nt, synthetic construct
  misc_feature 1..1380: note = derived and/or modified sequence opt2 from anti-HIV_Chain
  source 1..1380: mol_type = other RNA
gaggtccagctcgtcgagtccggcggcggcctcgtcaagcccggcggctccctccgcctcacctgcgtcgcctccggcttcaccttctccgacgtctggctcaactgggtccgccaggcccccggcaagggcctcgagtgggtcggccgcatcaagtcccgcaccgacggcggcaccaccgactacgccgcctccgtcaagggccgcttcaccatctcccgcgacgactccaagaacaccctctacctccagatgaactccctcaagaccgaggacaccgccgtctactcctgcaccaccgacggcttcatcatgatccgcggcgtctccgaggactactactactactacatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 19915 - RNA, 1413 nt, synthetic construct
  misc_feature 1..1413: note = derived and/or modified sequence opt2 from anti-HIV_Chain
  source 1..1413: mol_type = other RNA
atggagtggtccggcgtcttcatgttcctcctctccgtcaccgccggcgtccactcccaggtccagctccagcagtccggccccgaggtcgtcaagcccggcgcctccgtcaagatgtcctgcaaggcctccggctacaccttcacctcctacgtcatccactgggtccgccagaagcccggccagggcctcgactggatcggctacatcaacccctacaacgacggcaccgactacgacgagaagttcaagggcaaggccaccctcacctccgacacctccacctccaccgcctacatggagctctcctccctccgctccgaggacaccgccgtctactactgcgcccgcgagaaggacaactacgccaccggcgcctggttcgcctactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagttcgagggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcctccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 19916 - RNA, 645 nt, synthetic construct
  misc_feature 1..645: note = derived and/or modified sequence opt2 from anti-influenza_Fab
  source 1..645: mol_type = other RNA
atcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagcccgaggacttcgccgtctactactgccagcactactccaactggcccccccgcctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 19917 - RNA, 681 nt, synthetic construct
  misc_feature 1..681: note = derived and/or modified sequence opt2 from anti-influenza_Fab
  source 1..681: mol_type = other RNA
gtccagctcgtcgagtccggcggcggcgtcgtccagcccggcaagtccccccgcctctcctgcgccgcctccggccccaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgc

SEQ ID NO: 19918 - RNA, 1515 nt, synthetic construct
  misc_feature 1..1515: note = derived and/or modified sequence opt2 from anti-influenza_Fab
  source 1..1515: mol_type = other RNA
gccggctccaccgccaccctctgcctcggccaccacgccgtccccaacggcaccatcgtcaagaccatcaccaacgaccagatcgaggtcaccaacgccaccgagctcgtccagtcctcctccaccggcgagatctgcgactccccccaccagatcctcgacggcaagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacaacgagtccttcaactggaccggcgtcacccagaacggcacctcctccgcctgcatccgccgctccaagaactccttcttctcccgcctcaactggctcacccacctcaacttcaagtaccccgccctcaacgtcaccatgcccaacaacgagcagttcgacaagctctacatctggggcgtccaccaccccggcaccgacaaggaccagatcttcctctacgcccaggcctccggccgcatcaccgtctccaccaagcgctcccagcagaccgtctcccccaacatcggctcccgcccccgcgtccgcaacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggccgcggccaggccgccgacctcaagtccacccaggccgccatcgaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagaagaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggctccggccgcctcgtcccccgc

SEQ ID NO: 19919 - RNA, 657 nt, synthetic construct
  misc_feature 1..657: note = derived and/or modified sequence opt2 from anti-influenza_Fab
  source 1..657: mol_type = other RNA
caggtccagctcgtccagtccggcggcggcgtcgtccagcccggccgctccctccgcctctcctgcgccgcctccgagttcaccttccgcatgtacgccacccactgggtccgccaggcccccggcaagggcctcgagtgggtcgccctcatctcctacgacggctccaacaagtactacgccgactccgtcaagggccgcttcaccatctcccgcgacaactccatgaacaccgtctacctccagatgaacaccctccgccccgaggacaccgccgtctactactgcgcccgcgacctcggcggctacttcatccgcggcatcatggacgtctggggccagggcaccctcgtcaccgtctcctccgcctccaccaagggcccctccgtcttccccctcgccccctcctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaag

SEQ ID NO: 19920 - RNA, 642 nt, synthetic construct
  misc_feature 1..642: note = derived and/or modified sequence opt2 from anti-influenza_Fab
  source 1..642: mol_type = other RNA
gagctccagatgacccagtccccctcctccgtctccgcctccgtcggcgaccgcgtcaccatcacctgccgcgcctcccagggcatctcctcctggctcgcctggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcaggccaactccttccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 19921 - RNA, 993 nt, synthetic construct
  misc_feature 1..993: note = derived and/or modified sequence opt2 from anti-influenza_Fab
  source 1..993: mol_type = other RNA
gccgaccccggcgacaccatctgcatcggctaccacgccaacaactccaccgacaccgtcgacaccgtcctcgagaagaacgtcaccgtcacccactccgtcaacctcctcgaggactcccacaacggcaagctctgcaagctcaagggcatcgcccccctccagctcggcaagtgcaacatcgccggctggctcctcggcaaccccgagtgcgacctcctcctcaccgcctcctcctggtcctacatcgtcgagacctccaactccgagaacggcacctgctaccccggcgacttcatcgactacgaggagctccgcgagcagctctcctccgtctcctccttcgagaagttcgagatcttccccaagacctcctcctggcccaaccacgagaccaccaagggcgtcaccgccgcctgctcctacgccggcgcctcctccttctaccgcaacctcctctggctcaccaagaagggctcctcctaccccaagctctccaagtcctacgtcaacaacaagggcaaggaggtcctcgtcctctggggcgtccaccacccccccaccggcaccgaccagcagtccctctaccagaacgccgacgcctacgtctccgtcggctcctccaagtacaaccgccgcttcacccccgagatcgccgcccgccccaaggtccgcgaccaggccggccgcatgaactactactggaccctcctcgagcccggcgacaccatcaccttcgaggccaccggcaacctcatcgccccctggtacgccttcgccctcaaccgcggctccggctccggcatcatcacctccgacgcccccgtccacgactgcaacaccaagtgccagaccccccacggcgccatcaactcctccctccccttccagaacatccaccccgtcaccatcggcgagtgccccaagtacgtccgctccaccaagctccgcatggccaccggcctccgcaacatcccctccatccagtcccgc

SEQ ID NO: 19922 - RNA, 537 nt, synthetic construct
  misc_feature 1..537: note = derived and/or modified sequence opt2 from anti-influenza_Fab
  source 1..537: mol_type = other RNA
ggcctcttcggcgccatcgccggcttcatcgagggcggctggaccggcatgatcgacggctggtacggctaccaccaccagaacgagcagggctccggctacgccgccgaccagaagtccacccagaacgccatcgacggcatcaccaacaaggtcaactccgtcatcgagaagatgaacacccagttcaccgccgtcggcaaggagttcaacaacctcgagcgccgcatcgagaacctcaacaagaaggtcgacgacggcttcctcgacatctggacctacaacgccgagctcctcgtcctcctcgagaacgagcgcaccctcgacttccacgactccaacgtccgcaacctctacgagaaggtcaagtcccagctcaagaacaacgccaaggagatcggcaacggctgcttcgagttctaccacaagtgcgacgacgcctgcatggagtccgtccgcaacggcacctacgactaccccaagtactccgaggagtccaagctcaaccgcgaggagatcgacggcgtctccggccgc

SEQ ID NO: 19923 - RNA, 642 nt, synthetic construct
  misc_feature 1..642: note = derived and/or modified sequence opt2 from anti-influenza_Apo
  source 1..642: mol_type = other RNA
cagtccgtcctcacccagcccccctccgtctccgtcgcccccggccagaccgcccgcatcacctgcggcggcaacgacatcggccgcaagtccgtccactggaaccagcagaagcccggccaggcccccgtcctcgtcgtctgctacgactccgaccgcccctccggcatccccgagcgcttctccggctccaactccggcaacaccgccaccctcaccatctcccgcgtcgaggccggcgacgaggccgactactactgccaggtctgggactcctcctccgaccacgtcatcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 19924 - RNA, 687 nt, synthetic construct
  misc_feature 1..687: note = derived and/or modified sequence opt2 from anti-influenza_Apo
  source 1..687: mol_type = other RNA
gaggtccagctcgtccagtccggcgccgaggtcaagaagcccggcgcctccgtcaaggtctcctgcaaggcctccggctacaccttcaccgactaccacatcaactgggtccgccaggcccccggccagggcctcgagtggatgggctggatccaccccaactccggcgacaccaactacgcccagaagttccagggctgggtcaccatgacccgcgacaccgccatctccaccgcctacatggaggtcaacggcctcaagtccgacgacaccgccgtctactactgcgcccgcggcggcctcgagccccgctccgtcgactactactactacggcatggacgtctggggccagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgc

SEQ ID NO: 19925 - RNA, 333 nt, synthetic construct
  misc_feature 1..333: note = derived and/or modified sequence opt2 from anti-influenza-A_kappa_LightChain_V-Region
  source 1..333: mol_type = other RNA
gacatcgtcatgacccagtcccccgactccctcgccgtctccctcggcgcccgcgccaccatcaactgcaagtcctcccagtccgtcaccttcaactacaagaactacctcgcctggtaccagcagaagcccggccagccccccaaggtcctcatctactgggcctccgcccgcgagtccggcgtccccgaccgcttctccggctccggctccggcaccgacttcaccctcaccatctcctccctccaggccgaggacgtcgccgtctactactgccagcagcactaccgcaccccccccaccttcggccagggcaccaaggtcgagatcaag

SEQ ID NO: 19926 - RNA, 333 nt, synthetic construct
  misc_feature 1..333: note = derived and/or modified sequence opt2 from anti-influenza-A_kappa_LightChain_V-Region
  source 1..333: mol_type = other RNA
gacatcgtcatgacccagtcccccgactccctcgccgtctccctcggcgagcgcgccaccatcaactgcaagtcctcccagtccgtctcctccaacaacaagaactacctcgcctggtaccagcagaagcccggccagccccccaaggtcctcatctactgggcctccgcccgcgagtccggcgtccccgaccgcttctccggctccggctccggcaccgacttcaccctcaccatctcctccctccaggccgaggacgtcgccgtctactactgccagcagcactaccgcaccccccccaccttcggccagggcaccaaggtcgagatcaag

SEQ ID NO: 19927 - RNA, 333 nt, synthetic construct
  misc_feature 1..333: note = derived and/or modified sequence opt2 from anti-influenza-A_kappa_LightChain_V-Region
  source 1..333: mol_type = other RNA
gacatcgtcatgacccagtcccccgactccctcgccgtctccctcggcgagcgcgccaccatcaactgccgctcctcccagtccgtctcctccaacaacaagaacttcctcgcctggtaccaggagaagcccggccagccccccaaggtcctcatctactgggcctccgcccgcgagtccggcgtccccgaccgcttctccggctccggctccggcaccgacttcaccctcaccatctccggcctccaggccgaggacgtcgccgtctactactgccagcagcactaccgcaccccccccaccttcggccagggcaccaaggtcgagatcaag

SEQ ID NO: 19928 - RNA, 333 nt, synthetic construct
  misc_feature 1..333: note = derived and/or modified sequence opt2 from anti-influenza-A_kappa_LightChain_V-Region
  source 1..333: mol_type = other RNA
gacatcgtcatgacccagtcccccgactccctcgccgtctccctcggcgagcgcgccaccatcaactgcaagtcctcccagtccgtcaccttcaactacaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagcactaccgcaccccccccaccttcggccagggcaccaaggtcgagatcaag

SEQ ID NO: 19929 - RNA, 339 nt, synthetic construct
  misc_feature 1..339: note = derived and/or modified sequence opt2 from anti-influenza-A_kappa_LightChain_V-Region
  source 1..339: mol_type = other RNA
gacatcgtcatgacccagtcccccgactccctcgccgtctccctcggcgagcgcgccaccatcaactgcaagtcctcccagtccgtcctctactcctccaacaacaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagtactactccaccccccccaccttcggccagggcaccaaggtcgagatcaag

SEQ ID NO: 19930 - RNA, 333 nt, synthetic construct
  misc_feature 1..333: note = derived and/or modified sequence opt2 from anti-influenza-A_kappa_LightChain_V-Region
  source 1..333: mol_type = other RNA
gacatccagatgacccagtcccccgactccctcgccgtctccctcggcgcccgcgccaccatcaactgcaagtcctcccagtccgtcaccttcaactacaagaactacctcgcctggtaccagcagaagcccggccagccccccaaggtcctcatctactgggcctccgcccgcgagtccggcgtccccgaccgcttctccggctccggctccggcaccgacttcaccctcaccatctcctccctccaggccgaggacgtcgccgtctactactgccagcagcactaccgcaccccccccaccttcggccagggcaccaaggtcgagatcaag

SEQ ID NO: 19931 - RNA, 387 nt, synthetic construct
  misc_feature 1..387: note = derived and/or modified sequence opt2 from anti-influenza-A_HeavyChain_V-Region
  source 1..387: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctcctacgacggctccaacaagtactacgccgactccgtcaagggccgcttcaccatctcccgcgacaactccaagaacaccctctacctccagatgaactccctccgcgccgaggacaccgccgtctactactgcgccaaggactcccagctccgctccctcctctacttcgactggctctcccagggctacttcgactactggggccagggcaccctcgtcaccgtctcctcc

SEQ ID NO: 19932 - RNA, 387 nt, synthetic construct
  misc_feature 1..387: note = derived and/or modified sequence opt2 from anti-influenza-A_HeavyChain_V-Region
  source 1..387: mol_type = other RNA
caggtccagctcgtccagtccggcggcggcgtcgtccagcccggccgctccctccgcctctcctgcgtcgcctccggcttcaccttctccacctacgccatgcactgggtccgccaggcccccggccgcggcctcgagtgggtcgccgtcatctcctacgacggcaactacaagtactacgccgactccgtcaagggccgcttctccatctcccgcgacaactccaacaacaccctccacctcgagatgaacaccctccgcaccgaggacaccgccctctactactgcgccaaggactcccagctccgctccctcctctacttcgagtggctctcccagggctacttcgacccctggggccagggcaccctcgtcaccgtctcctcc

SEQ ID NO: 19933 - RNA, 387 nt, synthetic construct
  misc_feature 1..387: note = derived and/or modified sequence opt2 from anti-influenza-A_HeavyChain_V-Region
  source 1..387: mol_type = other RNA
caggtccagctcgtccagtccggcggcggcgtcgtccagcccggccgctccctccgcctctcctgcgccgcctccggcttcaccttctccacctacggcatgcactgggtccgccaggcccccggcaagggcctcgagtgggtcgccgtcatctcctacgacggcaactacaagtactacgccgactccgtcaagggccgcttcaccatctcccgcgacaactccaagaacaccctctacctcgagatgaactccctccgcaccgaggacaccgccctctactactgcgccaaggactcccagctccgctccctcctctacttcgactggctctcccagggctacttcgaccactggggccagggcaccctcgtcaccgtctcctcc

SEQ ID NO: 19934 - RNA, 387 nt, synthetic construct
  misc_feature 1..387: note = derived and/or modified sequence opt2 from anti-influenza-A_HeavyChain_V-Region
  source 1..387: mol_type = other RNA
caggtccagctcgtccagtccggcggcggcgtcgtcccccccggccgctccctccgcctctcctgcgccgcctccggcttcaccttctccacctacggcatgcactgggtccgccaggcccccggcaagggcctcgagtgggtcgccgtcatctcctacgacggcaactacaagtactacgccgactccgtccgcggccgcttcaccatctcccgcgacaactccaagaacaccctcaacctcgacatgaactccctccgcaccgaggacaccgccctctactactgcgccaaggactcccagctccgctccctcctctacttcgactggctctcccagggctacttcgaccactggggccagggcaccctcgtcaccgtctcctcc

SEQ ID NO: 19935 - RNA, 387 nt, synthetic construct
  misc_feature 1..387: note = derived and/or modified sequence opt2 from anti-influenza-A_HeavyChain_V-Region
  source 1..387: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccgtcatctcctacgacgccaactacaagtactacgccgactccgtcaagggccgcttcaccatctcccgcgacaactccaagaacaccctctacctccagatgaactccctccgcgccgaggacaccgccgtctactactgcgccaaggactcccagctccgctccctcctctacttcgagtggctctcccagggctacttcgactactggggccagggcaccctcgtcaccgtctcctcc

SEQ ID NO: 19936 - RNA, 387 nt, synthetic construct
  misc_feature 1..387: note = derived and/or modified sequence opt2 from anti-influenza-A_HeavyChain_V-Region
  source 1..387: mol_type = other RNA
caggtccagctcgtcgagtccggcggcggcgtcgtccagcccggccgctccctccgcctctcctgcgccgcctccggcttcaccttctccacctacgccatgcactgggtccgccaggcccccggcaagggcctcgagtgggtcgccgtcatctcctacgacggcaactacaagtactacgccgactccgtcaagggccgcttcaccatctcccgcgacaactccaagaacaccctctacctccagatgaactccctccgcgccgaggacaccgccgtctactactgcgccaaggactcccagctccgctccctcctctacttcgagtggctctcccagggctacttcgacccctggggccagggcaccctcgtcaccgtctcctcc

SEQ ID NO: 19937 - RNA, 387 nt, synthetic construct
  misc_feature 1..387: note = derived and/or modified sequence opt2 from anti-influenza-A_HeavyChain_V-Region
  source 1..387: mol_type = other RNA
caggtccagctcgtccagtccggcggcggcgtcgtccagcccggccgctccctccgcctctcctgcgtcgcctccggcttcaccttctccacctacgccatgcactgggtccgccaggcccccggccgcggcctcgagtgggtcgccgtcatctcctacgacggcaactacaagtactacgccgactccgtcaagggccgcttctccatctcccgcgacaactccaacaacaccctccacctcgagatgaacaccctccgcaccgaggacaccgccctctactactgcgccaaggactcccagctccgctccctcctctacttcgagtggctctcccagggctacttcgacccctggggccagggcaccctcgtcaccgtcacctcc

SEQ ID NO: 19938 - RNA, 330 nt, synthetic construct
  misc_feature 1..330: note = derived and/or modified sequence opt2 from anti-influenza-A_LightChain_V-Region
  source 1..330: mol_type = other RNA
aacttcatgctcacccagcccccctccgcctccggcacccccggccagcgcgtcaccatctcctgctccggctcctcctccaacatcggcggcaacaccgtccactggttccagcagctccccggcaccgcccccaagctcctcatctacaccaactccctccgcccctccggcgtccccgaccgcttctccggctccaagtccggcacctccgcctccctcgccatctccggcctccagtccgaggacgaggccgactactactgcgccgcctgggacgactccctcaacggccaggtcttcggcggcggcaccaagctcaccgtcctc

SEQ ID NO: 19939 - RNA, 390 nt, synthetic construct
  misc_feature 1..390: note = derived and/or modified sequence opt2 from anti-influenza-A_HeavyChain_V-Region
  source 1..390: mol_type = other RNA
caggtccagctcctcgagtccggcggcggcgtcgtccagcccggccgctccctccgcctctcctgcgccgcctccggcttcaccttctccaactacggcatgcactgggtccgccaggcccccggcaagggcctcgagtgggtcgccatcatctccttcgacggctccaagaagtactacgccaactccgtcaagggccgctccaccatctcccgcgacaactccaagaacaccctctccctccagatgaactccctcggccccgaggacaccgccctctactactgcgccaagctcccctccccctactacttcgactcccgcttcgtctgggtcgccgcctccgccttccacttctggggccagggcatcctcgtcaccgtctcctcc

SEQ ID NO: 19940 - RNA, 132 nt, synthetic construct
  misc_feature 1..132: note = derived and/or modified sequence opt2 from anti-influenza_Chain
  source 1..132: mol_type = other RNA
aacgtccccgagtggtcctacatcgtcgagaaggccaaccccgccaacgacctctgctaccccggcaacttcaacgactacgaggagctcaagcacctcctctcccgcatcaaccacttcgagaagatccag

SEQ ID NO: 19941 - RNA, 162 nt, synthetic construct
  misc_feature 1..162: note = derived and/or modified sequence opt2 from anti-influenza_Chain
  source 1..162: mol_type = other RNA
tccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 19942 - RNA, 291 nt, synthetic construct
  misc_feature 1..291: note = derived and/or modified sequence opt2 from anti-influenza_Chain
  source 1..291: mol_type = other RNA
atgtccctcctcaccgaggtcgagacccccatccgcaacgagtggggctgccgctgcaacggctcctccgaccccctcgccatcgccgccaacatcatcggcatcctccacctcatcctctggatcctcgaccgcctcttcttcaagtgcatctaccgccgcttcaagtacggcctcaagggcggcccctccaccgagggcgtccccaagtccatgcgcgaggagtaccgcaaggagcagcagtccgccgtcgacgccgacgacggccacttcgtctccatcgagctcgag

SEQ ID NO: 19943 - RNA, 300 nt, synthetic construct
  misc_feature 1..300: note = derived and/or modified sequence opt2 from anti-influenza_Chain
  source 1..300: mol_type = other RNA
atgaacaacgccaccttcaactgcaccaacatcaaccccatcacccacatccgcggctccatcatcatcaccatctgcgtctccctcatcgtcatcctcatcgtcttcggctgcatcgccaagatcttcatcaacaagaacaactgcaccaacaacgtcatccgcgtccacaagcgcatcaagtgccccgactgcgagcccttctgcaacaagcgcgacgacatctccaccccccgcgccggcgtcgacatcccctccttcatcctccccggcctcaacctctccgagggcacccccaac

SEQ ID NO: 19944 - RNA, 300 nt, synthetic construct
  misc_feature 1..300: note = derived and/or modified sequence opt2 from anti-influenza_Chain
  source 1..300: mol_type = other RNA
gagctcacccagtccccctcctccctctccgcctccgtcggcgactccgtcaccatcacctgccgcacctccgagcgcatctccacctacctcaactggtaccagcagaagcccggcaaggccccccgcctcctcgtctccggcgcctccaccctccagggcggcgtcccctcccgcttctccggctccggctccggcaccgccttcaccctcaccatcaactccctccagcccgaggacttcgccacctactactgccagcagtcctactccacccccctcaccttcggcggcggcacc

SEQ ID NO: 19945 - RNA, 300 nt, synthetic construct
  misc_feature 1..300: note = derived and/or modified sequence opt2 from anti-influenza_Chain
  source 1..300: mol_type = other RNA
atgacccagtccccctcctccatgtccgtctccctcggcgacaccgtctccatcacctgccacgcctcccaggacatctccggccacatcggctggctccagcagaagcccggcaagtccttcaagggcctcatctaccacggcaccaacctcgaggacggcgtcccctcccgcttctccggctccggctccggcgccgacttctccctcaccatctcctccctcgagtccgaggacttcgccgactactactgcgtccagtacgtccagttcccctggaccttcggcggcggcaccaag

SEQ ID NO: 19946 - RNA, 306 nt, synthetic construct
  misc_feature 1..306: note = derived and/or modified sequence opt2 from anti-influenza_Chain
  source 1..306: mol_type = other RNA
gacatccaggtcacccagtccccctcctccctctccgcctccgtcggcgaccgcgtcaccatctcctgccgcgcccagtccctctcctcctacctccactggtaccagcagaagcccggccagccccccaagctcctcatctacgccgccaccaccctccagtccggcgtcccctcccgcttctccggctccggctccggcaccgacttcaccctcaccatctccaccttccaggccgaggacgtcgccacctactactgccagcagtcccgcaccttcggccagggcaccaaggtcgagatcaag

SEQ ID NO: 19947 - RNA, 306 nt, synthetic construct
  misc_feature 1..306: note = derived and/or modified sequence opt2 from anti-influenza_Chain
  source 1..306: mol_type = other RNA
gacatccagatgacccagtccccctcctccctctccgcctccgtcggcgaccgcgtcaccatctcctgccgcgcccagtccctctcctcctacctccactggtaccagcagaagcccggccagccccccaagctcctcatctacgccgccaccaccctccagtccggcgtcccctcccgcttctccggctccggctccggcaccgacttcaccctcaccatctccaccttccaggccgaggacgtcgccacctactactgccagcagtcccgcaccttcggccagggcaccaaggtcgagatcaag

SEQ ID NO: 19948 - RNA, 309 nt, synthetic construct
  misc_feature 1..309: note = derived and/or modified sequence opt2 from anti-influenza_Chain
  source 1..309: mol_type = other RNA
gacatccagatcacccagtccccctcctccctctccgcctccgtcggcgaccgcgtcaccatcacctgccgcacctcccagtccctctcctcctacctccactggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcagtcccgcaccttcggccagggcaccaaggtcgagatcaag

SEQ ID NO: 19949 - RNA, 309 nt, synthetic construct
  misc_feature 1..309: note = derived and/or modified sequence opt2 from anti-influenza_Chain
  source 1..309: mol_type = other RNA
gacatccagatgacccagtccccctcctccctctccgcctccgtcggcgaccgcgtcaccatcacctgccgcacctcccagtccctctcctcctacctccactggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcagtcccgcaccttcggccagggcaccaaggtcgagatcaag

SEQ ID NO: 19950 - RNA, 309 nt, synthetic construct
  misc_feature 1..309: note = derived and/or modified sequence opt2 from anti-influenza_Chain
  source 1..309: mol_type = other RNA
gacatccaggtcacccagtccccctcctccctctccgcctccgtcggcgaccgcgtcaccatctcctgccgcgcctcccagcgcctcaactcctacctccactggtaccagcagacccccggccaggcccccaagctcctcatctacgccacctccaccctccagtccggcgtctccccccgcttctccggctccggctccggcaccgacttcaccctcaccatctcctccctccagcccgaggacgtcgccacctactactgccagctctcccgcaccttcggccacggcaccaaggtcgagatcaag

SEQ ID NO: 19951 - RNA, 309 nt, synthetic construct
  misc_feature 1..309: note = derived and/or modified sequence opt2 from anti-influenza_Chain
  source 1..309: mol_type = other RNA
gacatccagatgacccagtccccctcctccctctccgcctccgtcggcgaccgcgtcaccatctcctgccgcgcctcccagcgcctcaactcctacctccactggtaccagcagacccccggccaggcccccaagctcctcatctacgccacctccaccctccagtccggcgtctccccccgcttctccggctccggctccggcaccgacttcaccctcaccatctcctccctccagcccgaggacgtcgccacctactactgccagctctcccgcaccttcggccacggcaccaaggtcgagatcaag

SEQ ID NO: 19952 - RNA, 309 nt, synthetic construct
  misc_feature 1..309: note = derived and/or modified sequence opt2 from anti-influenza_Chain
  source 1..309: mol_type = other RNA
gacatccaggtcacccagtccccctcctccctctccgcctccgtcggcgaccgcatcaccatctcctgccgcacctcccagtccctccgctcctacctccactggtaccagcagaagcccggcaaggcccccaagctcctcatctacgcctcctccaccctccagtccggcgtcccctcccgcttctccggctccggctccggcaccgacttcaccctcaccatctccaacctccagcccgaggacttcgccacctactactgccagctctcccgcaccttcggccagggcaccaaggtcgagatcaag

SEQ ID NO: 19953 - RNA, 309 nt, synthetic construct
  misc_feature 1..309: note = derived and/or modified sequence opt2 from anti-influenza_Chain
  source 1..309: mol_type = other RNA
gacatccagatgacccagtccccctcctccctctccgcctccgtcggcgaccgcatcaccatctcctgccgcacctcccagtccctccgctcctacctccactggtaccagcagaagcccggcaaggcccccaagctcctcatctacgcctcctccaccctccagtccggcgtcccctcccgcttctccggctccggctccggcaccgacttcaccctcaccatctccaacctccagcccgaggacttcgccacctactactgccagctctcccgcaccttcggccagggcaccaaggtcgagatcaag

SEQ ID NO: 19954 - RNA, 309 nt, synthetic construct
  misc_feature 1..309: note = derived and/or modified sequence opt2 from anti-influenza_Chain
  source 1..309: mol_type = other RNA
gacatccagatgacccagtccccctcctccctctccgcctccgtcggcgaccgcgtcaccatcacctgccgcacctcccagtccctctcctcctacacccactggtaccagcagaagcccggcaaggcccccaagctcctcatctacgccgcctcctcccgcctctccggcgtcccctcccgcttctccggctccggctccggcaccgacttcaccctcaccatctcctccctccagcccgaggacttcgccacctactactgccagcagtcccgcaccttcggccagggcaccaaggtcgagatcaag

SEQ ID NO: 19955 - RNA, 309 nt, synthetic construct
  misc_feature 1..309: note = derived and/or modified sequence opt2 from anti-influenza_Chain
  source 1..309: mol_type = other RNA
gacatccagatgacccagtccccctcctccctctccgcctccgtcggcgaccgcgtcaccatcacctgccgcacctcccagtccctctcctcctacacccactggtaccagcagaagcccggcaaggcccccaagctcctcatctacgccgcctcctcccgcggctccggcgtcccctcccgcttctccggctccggctccggcaccgacttcaccctcaccatctcctccctccagcccgaggacttcgccacctactactgccagcagtcccgcaccttcggccagggcaccaaggtcgagatcaag

SEQ ID NO: 19956 - RNA, 309 nt, synthetic construct
  misc_feature 1..309: note = derived and/or modified sequence opt2 from anti-influenza_Chain
  source 1..309: mol_type = other RNA
gacatccagatgacccagtccccctcctccctctccgcctccgtcggcgaccgcgtcaccatcacctgccgcacctcccagtccctctcctcctacgaccactggtaccagcagaagcccggcaaggcccccaagctcctcatctacgccgcctcctcccgcctctccggcgtcccctcccgcttctccggctccggctccggcaccgacttcaccctcaccatctcctccctccagcccgaggacttcgccacctactactgccagcagtcccgcaccttcggccagggcaccaaggtcgagatcaag

SEQ ID NO: 19957 - RNA, 318 nt, synthetic construct
  misc_feature 1..318: note = derived and/or modified sequence opt2 from anti-influenza_Chain
  source 1..318: mol_type = other RNA
gagatcgtcatgacccagtcccccgacaccctctccgtctcccccggcgagcgcgccaccctctcctgccgcgcctcccagtccgtcaaccgccgcctcgcctggtaccagcagaagcccggccaggccccccgcctcctcatccacgacgcctccacccgcgccaccggcatccccgcccgcttctccggctccggctccggcaccgagttcaccctcaccatctcctccctccagtccgaggacttcgccgtctactactgccagcagtacgacaactggctctccttcggccagggcacccgcctcgagatcaag

SEQ ID NO: 19958 - RNA, 318 nt, synthetic construct
  misc_feature 1..318: note = derived and/or modified sequence opt2 from anti-influenza_Chain
  source 1..318: mol_type = other RNA
gacatccagctcacccagtccccctcctccctctccgcctccgtcggcgaccgcgtcaccatcacctgccgcgcctcccagggcatcctcaactgcctcgcctggtaccagcagaagcccggcaaggtccccaacctcctcatgtacgccgcctccaccctccagtccggcgtcccctcccgcttctccggctccggcttcggcaccgacttcaccctcaccatctcctccctccagcccgaggacgtcgccacctactactgccagacctacggcggcgtctccaccttcggcggcggcaccaaggtcgagatccgc

SEQ ID NO: 19959 - RNA, 318 nt, synthetic construct
  misc_feature 1..318: note = derived and/or modified sequence opt2 from anti-influenza_Chain
  source 1..318: mol_type = other RNA
tcctacgtcctcacccagcccccctccgtctccgtcgcccccggccagaccgcccgcatctcctgcggcggctccaacatcggcggcaagtccgtccactggtaccagcagaagcccggccaggcccccgtcctcgtcgtctacgacgactccggccgcccctccggcatccccgagcgcttctccggctccaactccggcgacaccgccaccctcaccatctcccgcgtcgaggccggcgacgaggccgactacttctgccaggtctgggacaacttcggcggcgtcttcggcaccggcaccaaggtcaccgtcctc

SEQ ID NO: 19960 - RNA, 318 nt, synthetic construct
  misc_feature 1..318: note = derived and/or modified sequence opt2 from anti-influenza_Chain
  source 1..318: mol_type = other RNA
gacatccagatgacccagtccccctcctccctctccgcctccgtcggcgaccgcgtcaccatcacctgccgcacctcccagtccatctcctcctacctcaactggtaccagcagaagcccggcaaggcccccaagctcctcatctacgccgcctcctccctccagtccggcgtcccctcccgcttctccggctccggctccggcaccgacttcaccctcaccatctccggcctccagcccgaggacttcgccacctactactgccagcagtcctactccatgcccgccttcggccagggcaccaagctcgagatcaag

SEQ ID NO: 19961 - RNA, 318 nt, synthetic construct
  misc_feature 1..318: note = derived and/or modified sequence opt2 from anti-influenza_Chain
  source 1..318: mol_type = other RNA
gacatccagatgacccagtcccccctctccgtctccgtctccgtcggcgaccgcgtcaccatcgcctgccgcgcctcccagtccatcgacaagttcctcaactggtaccagcagaagcccggcaaggcccccaagctcctcatctacggcgcctccaacctccactccggcgccccctcccgcttctccgcctccggctccggcaccgacttcaccctcaccatcaccaacatccagaccgaggacttcgccacctacctctgccagcagtccttctccgtccccgccttcggcggcggcaccaaggtcgagatcaag

SEQ ID NO: 19962 - RNA, 318 nt, synthetic construct
  misc_feature 1..318: note = derived and/or modified sequence opt2 from anti-influenza_Chain
  source 1..318: mol_type = other RNA
gacatccagatgacccagtccccctcctccctctccgcctccgtcggcgaccgcgtcaccatcacctgccgcgcctcccagtccatctccacctacctcaactggtaccagaagcgccccggcaaggcccccaagctcctcgtctacggcgcctccaccctccagtccggcgtcccctcccgcttctccggctccggctccggcaccgacttcaccctcaccatcgcctccctccagcccgaggactccgccacctactactgccagcagacctactccatccccctcttcggccagggcacccgcctcgagatcaag

SEQ ID NO: 19963 - RNA, 318 nt, synthetic construct
  misc_feature 1..318: note = derived and/or modified sequence opt2 from anti-influenza_Chain
  source 1..318: mol_type = other RNA
gacatccagatgacccagtccccctcctccctctccgcctccgtcggcgaccgcgtcaccatcacctgccgcgcctcccagtccatctccacctacctcaactggtaccagaagcgccccggcaaggcccccaagctcctcgtctacggcgcctcctccctccagtccggcgtcccctcccgcttctccggctccggctccggcaccgacttcaccctcaccatcgcctccctccagcccgaggactccgccgtctactactgccagcagacctactccatccccctcttcggccagggcacccgcctcgagatcaag

SEQ ID NO: 19964 - RNA, 318 nt, synthetic construct
  misc_feature 1..318: note = derived and/or modified sequence opt2 from anti-influenza_Chain
  source 1..318: mol_type = other RNA
gacatccagatgacccagtccccctcctccctctccgcctccgtcggcgaccgcgtcaccatcacctgccgcgcctcccagtccatctcccgctacctcaactggtaccagcagaagcccggcaaggcccccaagctcctcatctacggcgcctccaccctccagaacggcgccccctcccgcttctccggctccggctccggcaccgacttcaccctcaccatctcctccctccagcccgaggactccgccacctacctctgccagcagtcctactccgtccccgccttcggcggcggcaccaaggtcgaggtcaag

SEQ ID NO: 19965 - RNA, 318 nt, synthetic construct
  misc_feature 1..318: note = derived and/or modified sequence opt2 from anti-influenza_Chain
  source 1..318: mol_type = other RNA
ggcatccagatgacccagtccccctcctccctctccgcctccgtcggcgaccgcgtcaccatcacctgccgcgcctcccagtccatctcccgctacctcaactggtacctccagaagcccggcaaggcccccaagctcctcatctccggcgcctcctccctccagtccggcgtcccctcccgcttctccggcaccggctccggcaccgagttcaccctcaccatctcctccctccagcccgaggacttcgccacctactactgccagcagaccttctccatccccctcttcggccagggcaccaaggtcgagatcaag

SEQ ID NO: 19966 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtctccatcacctgccaggcctcccaggacatctcccgctacctcaactggtaccagcagaagcccggcgaggcccccaagctcctcatctacgacgcctccaacctcgagaccggcgtcccctcccgcttctccggctccggctccggcaccgacttcaccttcaccatctcctccctccagcccgaggacatcgccacctacttctgccagcagtacggctacctccccctcaccttcggccccggcaccaaggtcgactccaag

SEQ ID NO: 19967 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccttctccgtctccctcggcgaccgcgtcaccatcacctgcaaggcctccgaggacatctacaaccgcctcgcctggtaccagcagaagcccggcaacgccccccgcctcctcatctccgacaccaccaacctctggatcggcgtcccctcccgcttctccggctccggctccggcaaggactacaccctctccatcacctccctccagtccgaggacgtcgccacctactactgccagcagtactggtcctcccgcaccttcggcggcggcaccaagctcgagatcaagcgc

SEQ ID NO: 19968 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccttctccgtctccctcggcgaccgcgtcaccatcacctgcaaggcctccgaggacatctacaaccgcgtcgcctggtaccagcagaagcccggcaacgccccccgcctcctcatgtccgacgccacctccctcggcgccggcgtcccctcccgcttctccggctccggctccggcaaggaccacaccctctccatcacctccctccagaccgaggacgtcgccacctactactgccagcagtactggaacacccgcaccttcggcggcggcaccaagctcgagatcaagcgc

SEQ ID NO: 19969 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagtccatctccacctacctcaactggtaccagcagaagcccggcatcccccccaagctcctcatcaacgtcgcctcctccctccagtccggcgtcccctcccgcttctccggctccggctccggcaccgacttcaccctcaccatctcctccctccagcccgaggacttcgcctcctactactgccagcagacctactcctccccccccaccttcggccagggcaccaaggtcgagatcaag

SEQ ID NO: 19970 - RNA, 321 nt, synthetic construct
  misc_feature 1..321: note = derived and/or modified sequence opt2 from anti-influenza_Chain
  source 1..321: mol_type = other RNA
gacatccagatgacccagtccccctccaccctctccggctccgtcggcgaccgcgtcaccatcacctgccgcgcctcccagaacatcggcccctggctcgcctggtaccagcaggagtccggcaaggcccccaagctcctcatctcccgcgcctccatcctcgagtccggcgtcccctcccgcttctccggcaccggcaccggcaccgagttcaccctcaccatctcctccctccagcccgacgacttcgccacctactactgccagcactacaacgcctactggggcaccttcggccagggcaccaaggtcgagatcaac

SEQ ID NO: 19971 - RNA, 321 nt, synthetic construct
  misc_feature 1..321: note = derived and/or modified sequence opt2 from anti-influenza_Chain
  source 1..321: mol_type = other RNA
gtcatctggatgacccagtccccctccctcctctccgcctccaccggcgaccgcgtcaccatctcctgccgcatgtcccagggcatctcctcctacctcgcctggtaccagcagaagcccggcaaggcccccgagctcctcatccacaccgcctacaccctcaagtccggcgtcccctcccgcttctccggctccggctccggcaaggacttcaccctcaccatctccggcctccagtccgaggacttcgccacctactactgccagcagtactactccttcccctacaccttcggccagggcaccaaggtcgagatcaag

SEQ ID NO: 19972 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccgtctccgcctccgtcggcgaccgcgtcaccatcacctgccgcgcctcccaggacgtctccacctggctcgcctggtaccagctcaagcccggcaaggcccccaagctcctcatctacgccgcctcctccctccagtccggcgtcccctcccgcttctccggctccggctccggcaccgacttcaccctcaccgtctcctccctccagcccgaggacttcgccacctactactgccagcaggccaactccttccccttcaccttcggccccggcaccaaggtcgacatcaag

SEQ ID NO: 19973 - RNA, 321 nt, synthetic construct
  misc_feature 1..321: note = derived and/or modified sequence opt2 from anti-influenza_Chain
  source 1..321: mol_type = other RNA
gacatccagctcacccagtccccctccttcctctccgcctccgtcggcgacggcgtcaccatcacctgccgcgcctcccaggacatctacatctacctcgcctggtaccagcagaagcccggcaaggcccccaagctcctcatctacgccgcctccaccctccagggcggcgtcccctcccgcttctccggctccggctccggcaccgagttcaccctcaccatcaacaacctccagcccgaggacttcgccacctacttctgccagcagctcaacggctaccccctcaccttcggcggcggcaccaaggtcgagatcaag

SEQ ID NO: 19974 - RNA, 321 nt, synthetic construct
  misc_feature 1..321: note = derived and/or modified sequence opt2 from anti-influenza_Chain
  source 1..321: mol_type = other RNA
gacatccagctcacccagtccccctcctccctctccgcctccgtcggcgaccgcgtcaccctcacctgccaggcctcccaggacatccgcaagttcctcaactggtaccagcagaagcccggcaagggccccaagctcctcatctacgacgcctccaacctccagcgcggcgtcccctcccgcttctccggcggcggctccggcaccgacttcaccctcatcatctcctccctccagcccgaggacgtcggcacctactactgccagcagtacgacggcctccccttcaccttcggcggcggcaccaagctcgagatcaag

SEQ ID NO: 19975 - RNA, 321 nt, synthetic construct
  misc_feature 1..321: note = derived and/or modified sequence opt2 from anti-influenza_Chain
  source 1..321: mol_type = other RNA
gacatccagctcacccagtccccctcctccctctccgcctccatcggcgaccgcgtcaccatcacctgccaggcctcccaggacatccgcaactccctcaactggtacgagcacaagcccggcaaggcccccaagctcctcatccacgacgcctccaacctcgagaccggcgtcccctcccgcttctccggcggcggctccggcaccgacttcaccctcaccatctcctccctccagcccgaggacttcgccacctactactgccagcaggccaactccttccccctcaccttcggcggcggcaccaaggtcgagatcaag

SEQ ID NO: 19976 - RNA, 321 nt, synthetic construct
  misc_feature 1..321: note = derived and/or modified sequence opt2 from anti-influenza_Chain
  source 1..321: mol_type = other RNA
gacatccagctcacccagtccccctcctccctctccgcctccgtcggcgaccgcgtcaccatcacctgccgcgcctcccagggcatccgcaacgacctcggctggtaccagcagaagcccggcaacgcccccaagcgcctcatcttcggcgcctcctccctccagtccggcgtcccctcccgcttctccggctccggctccggcaccgagttcaccctcaccatctcctccctccagcccgaggacttcgccacctactactgcctccagcacaactcctacccctacaccttcggccagggcaccaagctcgagatcaag

SEQ ID NO: 19977 - RNA, 321 nt, synthetic construct
  misc_feature 1..321: note = derived and/or modified sequence opt2 from anti-influenza_Chain
  source 1..321: mol_type = other RNA
gacatccagctcacccagtccccctcctccctctccgcctccgtcggcgaccgcgtcaccatcacctgccgcgcctcccagtccatctcccgctacctcaactggtaccagcagaagcccggcaaggcccccaagctcctcctcttcgccgcctccaccctcctcgacggcgtcccctcccgcttctccggctccggctccggcaccgacttcaccctcaccatctcctccctccagcccgaggacttcgccacctactactgccagcgcaaccactccccctcctggaccttcggccagggcacccgcgtcgagatcaag

SEQ ID NO: 19978 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatgacctgccgcgcctcccagaacatccgctcctacctcaactggtaccagcagcgccccggcaccgcccccaagctcctcatctacgccgcctccaccctccactccggcgtcccctcccgcttctccggcggcggctccggcaccgacttcaccctcaccatcaacaacctccagcccgaggacttcgcctcctactactgccagcagtcctacgacaacccccagaccttcggccagggcaccaaggtcgagatcaag

SEQ ID NO: 19979 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgccaaccaggacatcggcatctacctcaactggtaccagcagaaccccggcaaggtccccaagctcctcctccacggcgcctcctccctccagggcggcgtcccctcccgcttctccgcctccggctccggcaccgacttcaccctcaccatccactccctccagcccgaggacctcgccacctactactgccagcagtcccgccgcctcccctacaccttcggccagggcacccgcgtcgagctcaag

SEQ ID NO: 19980 - RNA, 321 nt, synthetic construct
  misc_feature 1..321: note = derived and/or modified sequence opt2 from anti-influenza_Chain
  source 1..321: mol_type = other RNA
gacatccagatgacccagtccccctccaccctctccgcctccatcggcgaccgcgtcaccatcacctgccgcgcctcccagtccatcgcctcctggctcgcctggtaccagcagaagcccggcaaggcccccaagctcctcatctacgaggccgtcaacctcgagtccggcgtcccctcccgcttctccggctccggctccggcaccgacttcaccctcaccatctcctccctccagcccgacgacttcgccacctacttctgccagcactacggcaccatctcccagaccttcggcggcggcaccaaggtcgagatcaag

SEQ ID NO: 19981 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagtccatctcctcctacctcaactggtaccagcacaagcccggcaaggcccccaaggtcctcatgtacgccgtctccatcctccagtccggcgtcccctcccgcttctccggctccggctccggcgccgacttcaccctcaccatctcctccctccagcccgaggacttcgccacctactactgccagcagtcctactcctcccccctcaccttcggcggcggcaccaaggtcgagatcaag

SEQ ID NO: 19982 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagaacatcaagcgctacttcaactggtaccagcagaagcccggcaaggcccccaagctcctcatctacgccgcctccaacctcgagaacggcgtcccctcccgcttctccggctccggctccggcaccgacttcaccctcaccatctcctccctccagcccgaggacttcgccacctactactgccagcagtccttctccaagtcctggaccttcggccagggcaccaacgtcgacatcaag

SEQ ID NO: 19983 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagaacatctacaagtacctcaactggtaccagcagcgccccggcaaggcccccaagggcctcatctccgccgcctccggcctccagtccggcgtcccctcccgcttctccggctccggctccggcaccgacttcaccctcaccatcacctccctccagcccgaggacttcgccacctactactgccagcagtcctactccccccccctcaccttcggcggcggcacccgcgtcgagatcaag

SEQ ID NO: 19984 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctcctcctccgtcggcgaccgcgtcaccatcacctgccgcgcctcccagtccatcggcgcctacgtcaactggtaccagcagaaggccggcaaggccccccaggtcctcatcttcggcgcctccaacctccagtccggcgtcccctcccgcttctccggctccggctccggcaccgacttcaccctcaccatctcctccctccagcccgaggacttcgccacctacttctgccagcagacctactccacccccatcaccttcggccagggcacccgcctcgagatcaag

SEQ ID NO: 19985 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatctcctgccgcgcctcccagtccatctccacctacctcaactggtaccagcagcagcccggcaaggcccccaaggtcctcatcttcggcgccaccaacctccagtccggcgtcccctcccgcttctccggctccggctccggcaccgacttcaccctcaccatctcctccctccagcccgaggacttcgccacctactactgccagcagtcctacaacacccccctcatcttcggccagggcaccaagctcgagatcaag

SEQ ID NO: 19986 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatctcctgccgcgcctcccagtccatctccacctacctcaactggtaccagcagcagcccggcaaggcccccaaggtcctcatctccggcgccaccaacctccagtccggcgtcccctcccgcttctccggctccggctccggcaccgacttcaccctcaccatctcctccctccagcccgaggacttcgccacctactactgccagcagtcctacaacacccccctcatcttcggccagggcaccaagctcgagatcaag

SEQ ID NO: 19987 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcctcaccatcacctgccgcgcctcccagtccatctccacctacctccactggtaccagcagaagcccggcaaggcccccaagctcctcatctacgccgcctcctccctccagtccggcgtcccctcccgcttctccggctcccgctccggcaccgacttcaccctcaccatctcctccctccagcccgacgacttcgccacctactactgccagcagtcctactccccccccctcaccttcggccccggcaccaaggtcgacatgaag

SEQ ID NO: 19988 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagtccatctccaactacctcaactggtaccagcacaagcccggcgaggcccccaagctcctcaactacgccgcctcctccctccagtccggcgtcccctcccgcttctccgcctccggctccggcaccgacttcaccctcaccatctcctccctccagcccgaggacttcgccacctactactgccagcagtcctacaacacccccatcaccttcggccagggcacccgcctcgagatcaag

SEQ ID NO: 19989 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagtccatctccaactacctcaactggtaccagcacaagcccggcgaggcccccaagctcctcaactacgccgcctcctccctccagtccggcgtcccctcccgcttctccgcctccggctccggcaccgacttcaccctctccatctccggcctccagcccgaggacttcgccacctactactgccagcagtcctacaacacccccatcaccttcggccccggcacccgcctcgagatcaag

SEQ ID NO: 19990 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagtccatctccacctacctcaactggtaccagcagaagcccggcaaggcccccaagctcctcatctacgccgcctcctccctccactccggcgtcccctcccgcttctccggctccggctccggcaccgacttcgccctcaccatctcctccctccagcccgaggacttcgccacctactactgccagcagtcctactccccccccatcaccttcggccagggcacccgcctcgagatcaag

SEQ ID NO: 19991 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatcacctgccgcgcctcccagaccatctccacctacctcaactggtaccagcagaagtccggcaaggcccccaagctcctcatctacgccgcctccggcctccagtccggcgtcccctcccgcttctccggctccggctccggcaccgacttcaccctcaccatctcctccctccagcccgaggacttcgccacctacttctgccagcagtcctacaacacccccctcaccttcggccagggcaccaaggtcgagatcaag

SEQ ID NO: 19992 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccctctccgcctccgtcggcgaccgcgtcaccatctcctgccgcgcctcccagtccatctccacctacctcaactggtaccagcagcagcccggcaaggcccccaaggtcctcatctccggcgccaccgacctccagtccggcgtcccctcccgcttctccggctccggctccggcaccgacttcaccctcaccatctcctccctccagcccgaggacttcgccacctactactgccagcagtcctacaacacccccctcatcttcggccagggcaccaagctcgagatcaag

SEQ ID NO: 19993 - RNA, 321 nt, synthetic construct
  misc_feature 1..321: note = derived and/or modified sequence opt2 from anti-influenza_Chain
  source 1..321: mol_type = other RNA
gacatccaggtcacccagtccccctcctccctctccgcctccgtcggcgaccgcgtcaccatcacctgccgcgcctcccagaacatctacaagtacctcaactggtaccagcagcgccccggcaaggcccccaagggcctcatctccgccgcctccggcctccagtccggcgtcccctcccgcttctccggctccggctccggcaccgacttcaccctcaccatcacctccctccagcccgaggacttcgccacctactactgccagcagtcctactccccccccctcaccttcggcggcggcacccgcgtcgacatcaag

SEQ ID NO: 19994 - RNA, 321 nt, synthetic construct
  misc_feature 1..321: note = derived and/or modified sequence opt2 from anti-influenza_Chain
  source 1..321: mol_type = other RNA
cagtccgtcctcacccagcccccctccgagtccgtctcccccggccagaccgcctccgtcacctgctccggccacaagctcggcgacaagtacgtctcctggtaccagcagaagcccggccagtcccccgtcctcctcatctaccaggacaaccgccgcccctccggcatccccgagcgcttcatcggctccaactccggcaacaccgccaccctcaccatctccggcacccaggccctcgacgaggccgactactactgccaggcctgggactcctccaccgccgtcttcggcggcggcaccaagctcaccgtcctcggc

SEQ ID NO: 19995 - RNA, 321 nt, synthetic construct
  misc_feature 1..321: note = derived and/or modified sequence opt2 from anti-influenza_Chain
  source 1..321: mol_type = other RNA
gacatccagctcacccagtccccctcctccctctccgcctccgtcggcgaccgcgtcaccatcacctgccgcgcctcccagggcatctccacctacctcgcctggtaccagcagaagcccggcaaggtccccaagctcctcatctacgccgcctccaccctccagtccggcgtcccctcccgcttctccggctccggctccggcaccgacttcaccctcaccatctcctccctccagcccgaggacgtcgccacctactactgccagaagtacaactccgccccctccttcggccccggcaccaaggtcgacatcaagcgc

SEQ ID NO: 19996 - RNA, 321 nt, synthetic construct
  misc_feature 1..321: note = derived and/or modified sequence opt2 from anti-influenza_Chain
  source 1..321: mol_type = other RNA
tccgtcctcacccagcccccctccgcctccggctcccgcggccagtccatcaccatctcctgcaccggctccacctccgacatcggctcctacaactacgtctcctggtaccagcagcaccccggcaccgcccccaaggtcatcctctacgaggtctcccagcgcccctccggcgtccccgaccgcttctccggctccaagtccggcaacaccgccttcctcaccgtctccggcctccaggccgaggacgaggccgactactactgcgcctcctacgccggcaacaacatctacgtcttcggctccggcaccaaggtcacc

SEQ ID NO: 19997 - RNA, 321 nt, synthetic construct
  misc_feature 1..321: note = derived and/or modified sequence opt2 from anti-influenza_Chain
  source 1..321: mol_type = other RNA
tccgccctcacccagcccccctccgcctccggctcccgcggccagtccatcaccatctcctgcaccggctccacctccgacatcggctcctacaactacgtctcctggtaccagcagcaccccggcaccgcccccaaggtcatcctctacgaggtctcccagcgcccctccggcgtccccgaccgcttctccggctccaagtccggcaacaccgccttcctcaccgtctccggcctccaggccgaggacgaggccgactactactgcgcctcctacgccggcaacaacatctacgtcttcggctccggcaccaaggtcacc

SEQ ID NO: 19998 - RNA, 321 nt, synthetic construct
  misc_feature 1..321: note = derived and/or modified sequence opt2 from anti-influenza_Chain
  source 1..321: mol_type = other RNA
gagatcgtcctcacccagtcccccgccaccctctccctctcccccggcgagcgcgccaccctctcctgccgcgcctcccagtccgtctccaccttcctcgcctggtaccagcagaagcccggccaggccccccgcctcctcatgtacgacgcctccaaccgcgccaccggcatccccgcccgcttctccggctccggctccggcaccgacttcaccctcaccatctcctccctcgagcccgaggacttcgccatctactactgccagcagcgctcccactggccccccatcttcggccagggcacccgcctcgagatcaag

SEQ ID NO: 19999 - RNA, 321 nt, synthetic construct
  misc_feature 1..321: note = derived and/or modified sequence opt2 from anti-influenza_Chain
  source 1..321: mol_type = other RNA
gacatccagatgacccagtcccccgcctccctctccgtctccgtcggcgagaccgtcaccatcacctgccgcgcctccgagaagatctactccaacctcgcctggtaccagcagaaggagggcaagtccccccagctcctcgtctacgccgccatccgcctcgccgacggcgtcccctcccgcttctccggctccggctccggcacccagttctccctcaagatcaactccctccagtccgaggacttcggcacctactactgccagcacttctggggcacccccctcaccttcggcgccggcaccaagctcgagctcaag

SEQ ID NO: 20000 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccgtctccgcctccgtcggcgaccgcgtcaccatcacctgccgcgcctcccaggacatctccacctggctcgcctggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctacttctgccagcaggccaactccttcccccccaccttcggccagggcaccaagctcgagatcaag

SEQ ID NO: 20001 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccgtctccgcctccgtcggcgaccgcgtcaccatcacctgccgcgcctcccaggacatctccacctggctcgcctggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctacttctgccagcaggccaactccttcccccccaccttcggctgcggcaccaagctcgagatcaag

SEQ ID NO: 20002 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccgtctccgcctccgtcggcgaccgcgtcaccatcacctgccgcgcctcccaggacatctccacctggctcgcctggtaccagcagaagcccggcaagtgccccaagctcctcatctacgccgcctcctccctccagtccggcgtcccctcccgcttctccggctccggctccggcaccgacttcaccctcaccatctcctccctccagcccgaggacttcgccacctacttctgccagcaggccaactccttcccccccaccttcggccagggcaccaagctcgagatcaag

SEQ ID NO: 20003 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccgtctccgcctccgtcggcgaccgcgtcaccatcacctgccgcgcctcccaggacatctccacctggctcgcctggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcaggccaactccttcccccccaccttcggccagggcaccaagctcgagatcaag

SEQ ID NO: 20004 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccgtctccgcctccgtcggcgaccgcgtcaccatcacctgccgcgcctcccaggacatctccacctggctcgcctggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctactactgccagcaggccaactccttcccccccaccttcggctgcggcaccaagctcgagatcaag

SEQ ID NO: 20005 - RNA, 321 nt, synthetic construct
  misc_feature 1..321: note = derived and/or modified sequence opt2 from anti-influenza_Chain
  source 1..321: mol_type = other RNA
gacatccagatgacccagtccccctcctccgtctccgcctccgtcggcgaccgcgtcaccatcacctgccgcgcctcccaggacatctccacctggctcgcctggtaccagcagaagcccggcaagtgccccaagctcctcatctacgccgcctcctccctccagtccggcgtcccctcccgcttctccggctccggctccggcaccgacttcaccctcaccatctcctccctccagcccgaggacttcgccacctactactgccagcaggccaactccttcccccccaccttcggccagggcaccaagctcgagatcaag

SEQ ID NO: 20006 - RNA, 321 nt, synthetic construct
  misc_feature 1..321: note = derived and/or modified sequence opt2 from anti-influenza_Chain
  source 1..321: mol_type = other RNA
gagatcgtcctcacccagtcccccgccaccctctccctctcccccggcgagcgcgccaccctctcctgccgcgcctcccgctccatcaccaccttcctcgcctggtaccagcagaagcccggccaggccccccgcctcctcatctacgacgcctccaaccgcgccaccggcgtccccgcccgcttctccggctccggctccggcaccgacttcaccctcaccatcaactccctcgagcccgacgacttcgccatctactactgccagcagcgcgaccactggccccccatcttcggccagggcacccgcctcgagatcaag

SEQ ID NO: 20007 - RNA, 321 nt, synthetic construct
  misc_feature 1..321: note = derived and/or modified sequence opt2 from anti-influenza_Chain
  source 1..321: mol_type = other RNA
gagatcgtcctcacccagtcccccgccaccctctccctctcccccggcgagcgcgccaccctctcctgccgcgcctcccgctccatcaccaccttcctcgcctggtaccagcagaagcccggccaggccccccgcctcctcatctacgacgcctccaaccgcgccaccggcgtccccgcccgcttctccggctccggctccggcaccgacttcaccctcaccatcaactccctcgagcccgacgacttcgccatctactactgccagcagcgcgaccactggccccccatcttcggctgcggcacccgcctcgagatcaag

SEQ ID NO: 20008 - RNA, 324 nt, synthetic construct
  misc_feature 1..324: note = derived and/or modified sequence opt2 from anti-influenza_Chain
  source 1..324: mol_type = other RNA
gagatcgtcctcacccagtcccccggcaccctctccctctcccccggcgagcgcgccaccctctcctgccgcgcctcccagaccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggcaactccccctacaccttcggccagggcaccaagctcgagatcaag

SEQ ID NO: 20009 - RNA, 324 nt, synthetic construct
  misc_feature 1..324: note = derived and/or modified sequence opt2 from anti-influenza_Chain
  source 1..324: mol_type = other RNA
gagatcgtcctcacccagtcccccggcaccctctccgtctcccccggcgagcgcgccaccctctcctgccgcgcctcccagtccatctcctccggctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggcacctccccccagaccttcggccagggcaccaaggtcgagatcaag

SEQ ID NO: 20010 - RNA, 324 nt, synthetic construct
  misc_feature 1..324: note = derived and/or modified sequence opt2 from anti-influenza_Chain
  source 1..324: mol_type = other RNA
gaggtcgtcctcacccagtcccccggcaccctctccctctcccccggccagcgcgccaccctctcctgccgcgcctcccagtccgtctcctcctcctacctcgcctggtaccagcagaagcccggccaggccccccgcctcctcatctacgacgcctccaaccgcgccaccggcatccccgaccgcttctccggctccggctccggcaccgacttcaccctcaccatctcccgcctcgagcccgaggacttcgccgtctactactgccagcagtacggctcctccccctacaccttcggccagggcaccaagctcgagatcaag

SEQ ID NO: 20011 - RNA, 324 nt, synthetic construct
  misc_feature 1..324: note = derived and/or modified sequence opt2 from anti-influenza_Chain
  source 1..324: mol_type = other RNA
gacatccagctcacccagtccccctcctccctctccgcctccgtcggcgaccgcgtcaccatcacctgccgcgcctcccagggcatcatcacctacctcaactggtaccagcagaagcccggcaaggcccccaagctcctcatctacgccacctactccctccagaacggcgtcccctcccgcttctccggctccggctccggcaccgacttcaccctcaccatctcctccctccagcccgaggacttcgccacctactactgccagcagtcctactcctccctcatgttcaccttcggccagggcaccaagctcgacatcaag

SEQ ID NO: 20012 - RNA, 324 nt, synthetic construct
  misc_feature 1..324: note = derived and/or modified sequence opt2 from anti-influenza_Chain
  source 1..324: mol_type = other RNA
gagaccgtcctcacccagtcccccggcaccctctccctcacccccggcgagcgcgccaccctctcctgccgcgtcggccagtccgtctccggctcccacctcgcctggtaccagcagaagcccggccaggccccccgcctcctcatctacggcgcctcctcccgcgccaccggcatccccgaccgcttcggcggctccgtctccggcaccgacttcaccctcaccatctcccgcctcgagcccgaggactccgccgtctactactgccagcagtacggcgactcccgctacaccttcggccagggcaccaagctcgagatcaag

SEQ ID NO: 20013 - RNA, 324 nt, synthetic construct
  misc_feature 1..324: note = derived and/or modified sequence opt2 from anti-influenza_Chain
  source 1..324: mol_type = other RNA
gagatcgtcctcacccagtcccccggcaccctctccctctcccccggcgagcgcgccaccctctcctgccgcgcctcccagtccgtctcctcctcccagctcgcctggtaccagcagaagcccggccaggccccccgcctcatcatctacggcgcctccacccgcgccaccggcatccccgaccgcttctccggctccggctccggcaccgacttcaccctcaccatcggccgcctcgagcccgaggacttcgccgtcttcttctgccagcagtactccacctccccccccaccttcggccagggcaccaaggtcgacttcaag

SEQ ID NO: 20014 - RNA, 324 nt, synthetic construct
  misc_feature 1..324: note = derived and/or modified sequence opt2 from anti-influenza_Chain
  source 1..324: mol_type = other RNA
gacatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcgtcatgtacggcgccgccacccgcgccaccggcatccccgaccgcttctccggctccggctccggccccgacttcaccctcaccatctcccgcctcgagcccgaggacttcgccatgtactactgccagcagtacggcaactcccccatcaccttcggccagggcacccgcctcgagatcaag

SEQ ID NO: 20015 - RNA, 324 nt, synthetic construct
  misc_feature 1..324: note = derived and/or modified sequence opt2 from anti-influenza_Chain
  source 1..324: mol_type = other RNA
gagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctcccactggccccccatcaccttcggccagggcacccgcctcgagatcaag

SEQ ID NO: 20016 - RNA, 324 nt, synthetic construct
  misc_feature 1..324: note = derived and/or modified sequence opt2 from anti-influenza_Chain
  source 1..324: mol_type = other RNA
tcctacgagctcacccagcccccctccgtctccgtctcccccggccagaccgcccgcatcacctgctccggcgacgccctccccaagcagaacgcctactggtaccagcagaagcccggccaggcccccgtcctcctcatctacaaggactccgagcgcccctccggcatccccgagcgcttctccggctcctcctccggcaccaccgtcaccctcaccatctccggcgtccaggccgaggacgaggccgactactactgccagtccgccgactcctccggcacctcctgggtcttcggcggcggcaccaagctcaccgtcctc

SEQ ID NO: 20017 - RNA, 324 nt, synthetic construct
  misc_feature 1..324: note = derived and/or modified sequence opt2 from anti-influenza_Chain
  source 1..324: mol_type = other RNA
tcctacgtcctcacccaggccccctccgtctccgtcgcccccggccagaccgcccgcatcacctgcggcggcaacgccatcggctccaagaaggtccactggtaccagcacaaggccggccaggcccccgtcctcgtcgtctacgacgacaccgaccgcccctccggcatccccgagcgcttctccggctccaactcctggtccaccgccaccctcaccatcaaccgcgtcgaggccggcgacgaggccgactactactgccaggtctgggacttcaccatcgaccacgtcgtcttcggcggcggcaccaagctcaccgtcctc

SEQ ID NO: 20018 - RNA, 324 nt, synthetic construct
  misc_feature 1..324: note = derived and/or modified sequence opt2 from anti-influenza_Chain
  source 1..324: mol_type = other RNA
gagatcgtcctcacccagtcccccggcaccctctccctctcccccggcgagcgcgccaccctctcctgccgcgcctcccagtccgtctcctcctcctacctcgcctggtaccagaagaagcccggccaggccccccgcctcctcatctacggcgcctccacccgcgccaccggcatccccgaccgcttcaccggctccggctccggcaccgacttcaccctctccatctcccgcctcgagcccgaggacttcgccgtctactactgccagcacttcggcacctccgtcttcaccttcggcggcggcaccaaggtcgagatcaag

SEQ ID NO: 20019 - RNA, 324 nt, synthetic construct
  misc_feature 1..324: note = derived and/or modified sequence opt2 from anti-influenza_Chain
  source 1..324: mol_type = other RNA
gagatcgtcatgacccagtcccccgccaccctctccgtctcccccggcgagcgcgccaccctctcctgccgcgcctcccagtccgtcggcaactccctcgcctggtaccagcagcgccccggccaggccccccgcctcctcatctacggcgcctccacccgcgccaccggcatccccccccgcttctccggctccggctccggcaccgagttcaccctcaccatctcctccctccagaccgaggacttcgccgtctactactgccagcagtacatcaactggcgccccctctccttcggcggcggcaccaaggtcgagatcaag

SEQ ID NO: 20020 - RNA, 324 nt, synthetic construct
  misc_feature 1..324: note = derived and/or modified sequence opt2 from anti-influenza_Chain
  source 1..324: mol_type = other RNA
caggagtccggcgccgagctcgtccgccccggcgcctccgtcaagctctcctgcaaggactccggctacaccttcaccacctactggatgaactgggtcaagcagcgccccgagcagggcctcgagtggatcggccgcatcgacccctacgactccgagacccactacaaccagaagttcaaggacaaggccatcctcaccgtcgacaagtcctccaacaccgcctacatgcagctctcctccctcacctccgaggactccgccgtctactactgcgtccgcggcggctccaccgtcgcctacttcggcgtctggggccagggc

SEQ ID NO: 20021 - RNA, 324 nt, synthetic construct
  misc_feature 1..324: note = derived and/or modified sequence opt2 from anti-influenza_Chain
  source 1..324: mol_type = other RNA
gagatcgtcctcacccagtcccccggcaccctctccctctcccccggcgagcgcgccaccctctcctgccgcgcctcccagcgcgtctcctcctacctcgcctggtaccagcagaagcccggccaggccccccgcctcctcatctacggcgcctccacccgcgccgccggcatccccgaccgcttctccggctccggctccggcaccgacttcaccctcaccatctcccgcctcgagcccgaggactccgccgtctactactgccagcagtacggccgcacccccctcaccttcggcggcggcaccaaggtcgagatcaagcgc

SEQ ID NO: 20022 - RNA, 324 nt, synthetic construct
  misc_feature 1..324: note = derived and/or modified sequence opt2 from anti-influenza_Chain
  source 1..324: mol_type = other RNA
gagatcgtcatgacccagtcccccggcaccctctccctctcccccggcgagcgcgccaccctctcctgccgcgcctcccagtccgtctcctcctcctacctcgcctggtaccagcagaagcccggccaggccccccgcctcctcatcttcggcgcctcctcccgcgccaccggcatccccgaccgcttctccggctccggctccggcaccgacttcaccctcaccatctcccgcctcgagcccgaggacttcgccgtctactactgccagcagtacggctcctccctcaccttcggcggcggcaccaagctcgagatcaagcgc

SEQ ID NO: 20023 - RNA, 324 nt, synthetic construct
  misc_feature 1..324: note = derived and/or modified sequence opt2 from anti-influenza_Chain
  source 1..324: mol_type = other RNA
gagatcgtcctctaccagtcccccggcaccctctccctctcccccggcgagcgcgccaccctctcctgccgcgcctcccagcgcgtctcctcctacctcgcctggtaccagcagaagcccggccaggccccccgcctcctcatctacggcgcctccacccgcgccgccggcatccccgaccgcttctccggctccggctccggcaccgacttcaccctcaccatctcccgcctcgagcccgaggactccgccgtctactactgccagcagtacggccgcacccccctcaccttcggcggcggcaccaaggtcgagatcaagcgc

SEQ ID NO: 20024 - RNA, 324 nt, synthetic construct
  misc_feature 1..324: note = derived and/or modified sequence opt2 from anti-influenza_Chain
  source 1..324: mol_type = other RNA
gacatcgtcctcacccaggccccctccgtctccgtctcccccggccagaccgcctccatcacctgctccggcgaccgcctcggcgagaagttcgcctcctggtaccagcagaagcccggccagtcccccgtcctcgtcatctacgaggactccaagcgcccctccggcatccccgaccgcttctccggctccaactccggcaacaccgccaccctcaccatctccggcacccagatcatggacgagggcgacttcttctgccaggcctgggactcctccaccgtcgtcttcggcggcggcaccaagctcaccgtcctcggccag

SEQ ID NO: 20025 - RNA, 324 nt, synthetic construct
  misc_feature 1..324: note = derived and/or modified sequence opt2 from anti-influenza_Chain
  source 1..324: mol_type = other RNA
gacatcgagctcacccagtccccctccgtctccgtctcccccggccagaccgcctccatcacctgctccggcgacaagctcggcgacaagttcgtctgctggtaccagcagaaggccggccagtcccccatcgtcgtcatctaccaggacgacaagcgcccctccggcatccccgagcgcttctccggctccaactccggcaacaccgccaccctcaccatctccggcacccaggccatggacgaggccgactacttctgccaggcctgggactccaccaccgtcgtcttcggcggcggcaccaagctcaccgtcctcggccag

SEQ ID NO: 20026 - RNA, 324 nt, synthetic construct
  misc_feature 1..324: note = derived and/or modified sequence opt2 from anti-influenza_Chain
  source 1..324: mol_type = other RNA
cagtccgtcctcacccagcccccctccgcctccggctcccgcggccagtccatcaccatctcctgcaccggctccacctccgacatcggctcctacaactacgtctcctggtaccagcagcaccccggcaccgcccccaaggtcatcctctacgaggtctcccagcgcccctccggcgtccccgaccgcttctccggctccaagtccggcaacaccgccttcctcaccgtctccggcctccagaccgacgacgaggccgactactactgcgcctcctacgccggcaacaacatctacgtcttcggctccggcaccaaggtcacc

SEQ ID NO: 20027 - RNA, 327 nt, synthetic construct
  misc_feature 1..327: note = derived and/or modified sequence opt2 from anti-influenza_Chain
  source 1..327: mol_type = other RNA
aacttcatgctcacccagccccactccgtctccgagtcccccggcaagaccgtcaccatctcctgcaccggctccggcggcaacatcgcccgcaactacgtccagtggtaccagcagcgccccggctccgcccccgtcaccgtcatcctcgaggacgacaagcgcccctccggcatccccgaccgcttctccggctccatcgaccgctcctccaactccgcctccctcaccatctccggcctccgcaccgaggacgaggccctctactactgccagtcctacgacgactccgacctcgtcgtcttcggcggcggcaccaagctcacc

SEQ ID NO: 20028 - RNA, 327 nt, synthetic construct
  misc_feature 1..327: note = derived and/or modified sequence opt2 from anti-influenza_Chain
  source 1..327: mol_type = other RNA
atgctcgagcccctccagatcctctccatctgctccttcatcctctccgccctccacttcatggcctggaccatcggccacctcaaccagatcaagcgcggcgtcaacctcaagatccagatccgcaaccccaacaaggaggccatcaaccgcgaggtctccatcctccgccacaactaccagaaggagatccaggccaaggagaccatgaagaagatcctctccgacaacatggaggtcctcggcgaccacatcgtcgtcgagggcctctccaccgacgagatcatcaagatgggcgagaccgtcctcgaggtcgaggagctccag

SEQ ID NO: 20029 - RNA, 327 nt, synthetic construct
  misc_feature 1..327: note = derived and/or modified sequence opt2 from anti-influenza_Chain
  source 1..327: mol_type = other RNA
gacatccgcctcacccagtcccccgccaccctctccgtctcccccggcgagcgcgccaccctctcctgccgcgcctcccactccgtctcccgcaacctcgcctggtaccagcagaagcccggccgcgccccccgcctcctcgtctacgacacctcctcccgcgccaccggcatccccgcccgcttctccggctccggctccggcaccgagttcaccctcaccatctcctccctccagtccgaggacttcgccgtctactactgccagcagtacaacaactggccccgcaccttcggccagggcaccaaggtcgacatcaagcgcacc

SEQ ID NO: 20030 - RNA, 327 nt, synthetic construct
  misc_feature 1..327: note = derived and/or modified sequence opt2 from anti-influenza_Chain
  source 1..327: mol_type = other RNA
gagatcgtcatgacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctccacccgcgccaccggcgtccccgaccgcttccacggcggcggctccggcaccgacttcaccctcaccatctcccgcctcgagcccgaggacttcgccgtctactactgccagcagtacgacacctcctccggcctcaccttcggcggcggcaccaaggtcgagatcaag

SEQ ID NO: 20031 - RNA, 327 nt, synthetic construct
  misc_feature 1..327: note = derived and/or modified sequence opt2 from anti-influenza_Chain
  source 1..327: mol_type = other RNA
gagatcgtcatgacccagttccccgccaccctctccgtctcccccggcgagcgcgtcaccctctcctgccgcgcctcccagtccgtctccaacaacctcgcctggtaccagcagaagcccggccagcccccccgcctcctcatctacgacgcctccacccgcgccaccggcgtccccgccaagttctccggcaccggctccggcaccgagttcaccctctccatctcctccctccagtccgaggacttcgccgtctactactgccagcagtaccacaactggcccccctcctactccttcggcctcggcaccaagctcgagatcaag

SEQ ID NO: 20032 - RNA, 327 nt, synthetic construct
  misc_feature 1..327: note = derived and/or modified sequence opt2 from anti-influenza_Chain
  source 1..327: mol_type = other RNA
gagatcatcctcgcccagtcccccggcaccctctccctctcccccggcgagcgcgccaccctctcctgccgcgcctcccagttcgtctccacccgctccctcgcctggtaccagcagcgccccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcactacggctactccccccgctacgccttcggccagggctccaaggtcgagatcaag

SEQ ID NO: 20033 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccggcaccctctccctctcccccggcgagcgcgccaccctctcctgccgcgcctcccacttcgtcaactaccgctccctcgcctggtaccagcagacccccggccaggtcccccgcctcctcatctacggcgcctccacccgcgccaccggcatccccgaccgcttctccggctccggctccggcaccgacttcaccctcaccatctcccgcctcgagcccgaggacttcgccgtctacttctgccagcagtacggcggctccccccgctacaccttcggccagggcacccgcctcgagatcaag

SEQ ID NO: 20034 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccggcaccctctccctctcccccggcgagcgcgccaccctctcctgccgcgcctcccacttcgtcatcggccgcgccgtcgcctggtaccagcagaagcccggccaggccccccgcctcctcatctacggcgcctcctcccgcgccaccggcatccccgaccgcttctccggctccggctccggcaccgacttcaccctcaccatctcccgcctcgagaccgaggacttcgccgtcttctactgccagcactacggctcctccccccgctacgccttcggccagggcaccaagctcgagatcaag

SEQ ID NO: 20035 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccctctcccccggcgagcgcgccaccctctcctgccgcgcctcccagtccgtcggcaactacctcgcctggtaccagcagaagcccggccaggccccccgcctcctcatctacgactcctccaaccgcgcccccggcatccccgcccgcttctccggctccggctccggcaccgacttcaccctcaccatctcctccctcgcccccgaggacttcgccgtctactactgccagcagcgctccaagtggccccccatgtactccttcggccacggcaccaagctcgagatcaag

SEQ ID NO: 20036 - RNA, 327 nt, synthetic construct
  misc_feature 1..327: note = derived and/or modified sequence opt2 from anti-influenza_Chain
  source 1..327: mol_type = other RNA
caggccgtcgtcacccaggagccctccctcaccgtctcccccggcggcaccgtcaccctcacctgcggctcctccaccggccccgtcacctccggccactacccctactggttccagcagaagcccggccaggccccccgcaccctcatctccgccacctccaacacccactcctggacccccgcccgcttctccggctccctcctcggcggccgcgccgccctcaccctctccggcgcccagcccgaggacgaggccgactactactgcttcctctcctactccggcgcctgggtcttcggcggcggcaccaccctcaccgtcctc

SEQ ID NO: 20037 - RNA, 327 nt, synthetic construct
  misc_feature 1..327: note = derived and/or modified sequence opt2 from anti-influenza_Chain
  source 1..327: mol_type = other RNA
gccatccagatgacccagtccccctcctccctctccgcctccgtcggcgaccgcgtcaccatcacctgccgcgcctcccagaacatccgctcctacctcaactggtaccagcagaagcccggcaaggcccccaacctcctcatctacggcaccacctccctcgagtccggcgtcccctcccgcttctccggctccggctccggcaccgacttcaccctcaccatctcctccctccagcccgaggacttcgccacctactactgccagcagtcctaccacaccccccagaccttcggccagggcaccaaggtcgagatcaagcgcacc

SEQ ID NO: 20038 - RNA, 327 nt, synthetic construct
  misc_feature 1..327: note = derived and/or modified sequence opt2 from anti-influenza_Chain
  source 1..327: mol_type = other RNA
gacatccagatgacccagtccccctcctccctctccgcctccgtcggcgaccgcatcaccatcacctgccgcgcctcccagggcatcgacaactacctcgcctggttccagcagaagcccggcaaggtccccgagctcctcatctacgccgcctccaccctccagtccggcgtcccctcccgcttctccggctccggctccggcaccggcttcaccctcaccatctcctccctccagcccgaggacgtcgccacctactactgccagaagtacgactccgcccccctcaccttcggcggcggcaccaaggtcgacatcaagcgcacc

SEQ ID NO: 20039 - RNA, 327 nt, synthetic construct
  misc_feature 1..327: note = derived and/or modified sequence opt2 from anti-influenza_Chain
  source 1..327: mol_type = other RNA
gacatccagctcacccagtccccctcctccctctccgcctccgtcggcgaccgcgtcaccatcacctgccgcgcctcccagggcatcaccgactacctcgcctggtaccagcagaagcccggcaccatccccaagctcctcatctacgccgcctccaccctccagtccggcgtcccctcccgcttctccggcggcggctacggcaccgacttcaccctcaccatctcctccctccagcccgaggacgtcgccacctactactgccagaagtacaactccgcccccctcaccttcggcggcggcaccaaggtcgagatcaagcgcacc

SEQ ID NO: 20040 - RNA, 327 nt, synthetic construct
  misc_feature 1..327: note = derived and/or modified sequence opt2 from anti-influenza_Chain
  source 1..327: mol_type = other RNA
gacatcgtcatgacccagtcccccttctccctctccctctcccccggcgagcgcgccaccctctcctgccgcgcctcccagtccatctccaactacctcgcctggtaccagcagaagcccggccaggccccccgcctcctcatctacgactcctccaaccgcgccaccggcgtccccgcccgcttctccggctccggctccggcaccgacttcaccctcaccatctcctccctcgagcccgaggacttcgccgtctactactgccagcagcgctccaactggatgtacaccttcggccagggcaccaaggtcgagatcaagcgcacc

SEQ ID NO: 20041 - RNA, 327 nt, synthetic construct
  misc_feature 1..327: note = derived and/or modified sequence opt2 from anti-influenza_Chain
  source 1..327: mol_type = other RNA
gacatccagatgacccagtccccctcctccctctccgcctccgtcggcgaccgcgtcaccatcacctgccgcgcctcccagggcatctcctcctacctcgcctggtaccagcagaagcccggcaaggtccccaccctcctcatctacgacgcctccaccctccgctccggcgtcccctcccgcttctccggctccggctccgccaccgacttcaccctcaccatctcctccctccagcccgaggacgtcgccacctactactgccagcgctacaactccgccccccccatcaccttcggccagggcacccgcctcgagatcaagcgc

SEQ ID NO: 20042 - RNA, 327 nt, synthetic construct
  misc_feature 1..327: note = derived and/or modified sequence opt2 from anti-influenza_Chain
  source 1..327: mol_type = other RNA
gagatcgtcatgacccagtcccccggcaccctctccctctcccccggcgagcgcgccaccctctcctgccgcgcctcccagtccgtctcctcctcctacctcgcctggtaccagcagaagcccggccaggccccccgcctcctcatctacgacgcctcctcccgcgccaccgacatccccgaccgcttctccggctccggctccggcaccgacttcaccctcaccatctcccgcctcgagcccgaggacttcgccgtctactactgccagcagtacggctcctccctctggaccttcggccagggcaccaaggtcgagatcaagcgc

SEQ ID NO: 20043 - RNA, 327 nt, synthetic construct
  misc_feature 1..327: note = derived and/or modified sequence opt2 from anti-influenza_Chain
  source 1..327: mol_type = other RNA
tcctacgtcctcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccacgccgtcttcggcggcggcacccagctcaccgtcctcggc

SEQ ID NO: 20044 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccccccgcaccttcggcggcggcaccaaggtcgagatcaagcgc

SEQ ID NO: 20045 - RNA, 327 nt, synthetic construct
  misc_feature 1..327: note = derived and/or modified sequence opt2 from anti-influenza_Chain
  source 1..327: mol_type = other RNA
tcctacgtcctcacccagcccccctccgtctccgtcgcccccggccagaccgcccgcatcacctgcggcggcaacaacatcggctccaagggcgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccacgtcgtcttcggcggcggcaccaagctcaccgtcctcggc

SEQ ID NO: 20046 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccggcaccctctccctctcccccggcgagcgcgccaccctctcctgccgcgcctcccagtccgtctcctccaactacctcggctggacccagcagaagcccggccaggccccccgcctcctcatctacggcgcctcctcccgcgcctccggcatccccgaccgcttctccggcggcggctccggcaccgacttcaccctcaccatctcccgcctcgagcccgaggacttcgccgtctactactgccagcagtacggctcctcccccctcaccttcggcggcggcaccaaggtcgagatcaagcgc

SEQ ID NO: 20047 - RNA, 327 nt, synthetic construct
  misc_feature 1..327: note = derived and/or modified sequence opt2 from anti-influenza_Chain
  source 1..327: mol_type = other RNA
cagtccgtcgtcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccactacgtcttcggcaccggcaccaaggtcaccgtcctcggc

SEQ ID NO: 20048 - RNA, 327 nt, synthetic construct
  misc_feature 1..327: note = derived and/or modified sequence opt2 from anti-influenza_Chain
  source 1..327: mol_type = other RNA
tcctacgtcctcacccagcccccctccgagtccgtcgcccccggccagaccgcccgcatcacctgcggcggcaacaacatcggccgcaactccgtccactggtaccagcagaagcccggccaggcccccgtcctcgtcgtctacgacgactccgaccgcccctccggcatccccgagcgcttctccggctccaagtccggcaacaccgccaccctcatcatctcccgcgtcgaggtcggcgacgaggccgactactactgccaggtctggcactcctcctccgaccactacgtcttcggcaccggcaccaaggtcaccgtcctcggc

SEQ ID NO: 20049 - RNA, 327 nt, synthetic construct
  misc_feature 1..327: note = derived and/or modified sequence opt2 from anti-influenza_Chain
  source 1..327: mol_type = other RNA
gagatcgtcatgacccagtcccccggcaccctctccctctcccccggccagcgcgccaccctctcctgccgcgcctcccagtccgtctcctcctcctacctcgcctggtaccagcagaagcccggccaggccccccgcctcctcatgtacggcgcctcctcccgcgccaccggcatccccgaccgcttctccggctccggctccggcaccgacttcaccctcaccatctcccgcctcgagcccgaggacttcgccgtctactactgccagcagtacggctcctcctccctcaccttcggcggcggcaccaagctcgagatcaagcgc

SEQ ID NO: 20050 - RNA, 327 nt, synthetic construct
  misc_feature 1..327: note = derived and/or modified sequence opt2 from anti-influenza_Chain
  source 1..327: mol_type = other RNA
caggccggcctcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccacgtcgtcttcggcggcggcaccaagctcaccgtcctcggc

SEQ ID NO: 20051 - RNA, 327 nt, synthetic construct
  misc_feature 1..327: note = derived and/or modified sequence opt2 from anti-influenza_Chain
  source 1..327: mol_type = other RNA
cagtccgtcgtcacccagcccccctccgagtccgtcgcccccggccagaccgcccgcatcacctgcggcggccacaacatcggctccaactccgtccactggtaccagcagaagcccggccaggcccccgtcctcgtcgtctacgacaactccgaccgcccctccggcatccccgagcgcttctccggctccaactccggcaacaccgccaccctcaccatctcccgcgtcgaggccggcgacgaggccgactactactgccaggtctggggctcctcctccgaccactacgtcttcggcaccggcaccaaggtcaccgtcctcggc

SEQ ID NO: 20052 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccggcaccctctccctctcccccggcgagcgcgccaccctctcctgccgcgcctcccagtccgtctcctccaactacctcggctggtaccagcagaagcccggccaggccccccgcctcctcatctacggcgcctcctcccgcgcctccggcatccccgaccgcttctccggcggcggctccggcaccgacttcaccctcaccatctcccgcctcgagcccgaggacttcgccgtctactactgccagcagtacggctcctcccccctcaccttcggcggcggcaccaaggtcgagatcaagcgc

SEQ ID NO: 20053 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaag

SEQ ID NO: 20054 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtctcccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactaccccccccgcctcaccttcggcggcggctccaaggtcgagatcaag

SEQ ID NO: 20055 - RNA, 327 nt, synthetic construct
  misc_feature 1..327: note = derived and/or modified sequence opt2 from anti-influenza_Chain
  source 1..327: mol_type = other RNA
gagatcgtcatgacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaag

SEQ ID NO: 20056 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtctcctccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaag

SEQ ID NO: 20057 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtcgaccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaag

SEQ ID NO: 20058 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtctcccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaag

SEQ ID NO: 20059 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtctcccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaacttccccccccgcctcaccttcggcggcggctccaaggtcgagatcaag

SEQ ID NO: 20060 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaacttccccccccgcctcaccttcggcggcggctccaaggtcgagatcaag

SEQ ID NO: 20061 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactaccccccccgcctcaccttcggcggcggctccaaggtcgagatcaag

SEQ ID NO: 20062 - RNA, 327 nt, synthetic construct
  misc_feature 1..327: note = derived and/or modified sequence opt2 from anti-influenza_Chain
  source 1..327: mol_type = other RNA
gagaccaccctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactggcccccccgcctcaccttcggcggcggcaccaaggtcgagatcaag

SEQ ID NO: 20063 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactggcccccccgcctcaccttcggcggcggcaccaaggtcgagatcaag

SEQ ID NO: 20064 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagcccgaggacttcgccgtctactactgccagcactactccaactggcccccccgcctcaccttcggcggcggcaccaaggtcgagatcaag

SEQ ID NO: 20065 - RNA, 327 nt, synthetic construct
  misc_feature 1..327: note = derived and/or modified sequence opt2 from anti-influenza_Chain
  source 1..327: mol_type = other RNA
gagatcgtcatgacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactggcccccccgcctcaccttcggcggcggcaccaaggtcgagatcaag

SEQ ID NO: 20066 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaacttccccccccgcctcaccttcggcggcggcaccaaggtcgagatcaag

SEQ ID NO: 20067 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactaccccccccgcctcaccttcggcggcggcaccaaggtcgagatcaag

SEQ ID NO: 20068 - RNA, 327 nt, synthetic construct
  misc_feature 1..327: note = derived and/or modified sequence opt2 from anti-influenza_Chain
  source 1..327: mol_type = other RNA
gagatcgtcctcacccagtcccccgccaccctctccgtctcccccggcgagcgcgtcaccctctcctgccgcgcctcccagtccgtcgccaacaacctcgcctggtaccagcagaagcccggccagtccccccgcctcctcatctacggcgcctccacccgcgacaccggcatccccgcccgcttctccggctccggctccggcaccgagttcaccctcaccatctcctccctccagtccgaggacttcgccgtctactactgccagcagtacaacaactggccccccatgtacaccttcggccagggcaccaagctcgagatcaag

SEQ ID NO: 20069 - RNA, 327 nt, synthetic construct
  misc_feature 1..327: note = derived and/or modified sequence opt2 from anti-influenza_Chain
  source 1..327: mol_type = other RNA
gacatcgtcatgacccagtccccctccaccctctccgcctccgtcggcgaccgcgtcaccatcacctgccgcgcctcccagtccatcggcaactggctcgcctggtaccagcagaagcccggcaaggcccccaagctcctcatctacaaggtctccaccctcgagtccggcgtcccctcccgcttctccggctccggctccggcaccgagttcaccctcaccatcaactccctccagcccgacgacttcgccacctactactgccagcgctacacctccaactcccagggcttcaccttcggccagggcaccaagctcgagatcaag

SEQ ID NO: 20070 - RNA, 327 nt, synthetic construct
  misc_feature 1..327: note = derived and/or modified sequence opt2 from anti-influenza_Chain
  source 1..327: mol_type = other RNA
gacatcgtcatgacccagtcccccgccaccctctccgtctcccccggcgagcgcgccaccctctcctgccgcgcctcccaggtcgtcggcaccaacctcgcctggtaccagcagaagcccggccaggccccccgcctcctcatctacgccgcctccacccgcgccaccggcatccccgcccgcttctccggctccggcttcggcaccgacttcaccctcaccatctcctccctccagtccgaggacttcgccgtctactactgccagcagtacaacaactggcccctctccttcggcggcggcaccaaggtcgagatccgccgcacc

SEQ ID NO: 20071 - RNA, 327 nt, synthetic construct
  misc_feature 1..327: note = derived and/or modified sequence opt2 from anti-influenza_Chain
  source 1..327: mol_type = other RNA
gacatccagatgacccagtccccctcctccctctccgcctccgtcggcgaccgcgtcaccatcgtctgccgcgcctcccagggcatcaacacccacctccactggtaccagcagaagcccggcaaggcccccaagctcctcatctactccgcctccaccctccacaccggcgtcccctcccgcctctccggctccggctccggcaccgacttcaccctctccatctcctccctccagcccgaggacttcgccacctactactgccagcagtcctacaactacccccgcaccttcggccagggcaccaacgtcgacatcaagcgcacc

SEQ ID NO: 20072 - RNA, 327 nt, synthetic construct
  misc_feature 1..327: note = derived and/or modified sequence opt2 from anti-influenza_Chain
  source 1..327: mol_type = other RNA
gacatcctcatgacccagtccccctcctccctctccgcctccgtcggcgaccgcgtcaccatcacctgccgcgcctcccaggacatccgcaaccgcctcgcctggtaccagcagaagcccggcaaggcccccaagcgcctcatctacgccgcctcctccctccagtccggcgtcccctcccgcttctccggctccggctccggcaccgagttcaccctcaccatcaactccctccagcccgaggacttcgccacctactactgcctccagcacaactcctacccctggaccttcggccccggcaccaaggtcgagatcaagcgcacc

SEQ ID NO: 20073 - RNA, 327 nt, synthetic construct
  misc_feature 1..327: note = derived and/or modified sequence opt2 from anti-influenza_Chain
  source 1..327: mol_type = other RNA
gacatcgtcatgacccagtcccccgccaccctctccgtctcccccggcgagggcgccaccctctcctgccgcgcctcccagggcatcggctccaacctcgcctggtaccagcacaagcccggccaggccccccgcctcctcatctacgccgcctccacccgcgccaccggcgtccccgcccgcttctccggctccggctccggcaccgagttcaccctcaccatctcctccctccagtccgaggacctcgccgtctacttctgccagcagtacaacacctggcccctcaccttcggcggcggcaccaaggtcgagatcatccgcacc

SEQ ID NO: 20074 - RNA, 327 nt, synthetic construct
  misc_feature 1..327: note = derived and/or modified sequence opt2 from anti-influenza_Chain
  source 1..327: mol_type = other RNA
gacatcgtcatgacccagtccccctccaccctctccgcctccgtcggcgaccgcgtcaccatcacctgccgcgcctcccagaccatctaccgctggctcgcctggtaccagcagaagcccggcaaggcccccaaggtcctcatctacaaggcctccaccctcgagtccggcgtcccctcccgcttctccggctccggctccggcaccgagttcaccctcgccatctcctccctccagcccgacgacttcgccacctactactgccagcagtacaactccttcccctaccgcttcggccagggcaccaaggtcgagatcaagcgcacc

SEQ ID NO: 20075 - RNA, 327 nt, synthetic construct
  misc_feature 1..327: note = derived and/or modified sequence opt2 from anti-influenza_Chain
  source 1..327: mol_type = other RNA
gacatcgtcatgacccagtccccctcctccctctccgcctccgtcggcgaccgcgtctccatcacctgccgcgcctcccagaccatcacccgcttcctcaactggtaccagcagaagcccggcaagggccccaagctcctcatctacgccgcctccaccgtccaccgcggcgtcccctcccgcttctccggctccggctccggcaccgacttcaccctcaccatctcctccctccagcccgaggacttcgccacctactactgccagcagtcctactccgcccccttcaccttcggccccggcaccaccgtcgacatccgccgcacc

SEQ ID NO: 20076 - RNA, 327 nt, synthetic construct
  misc_feature 1..327: note = derived and/or modified sequence opt2 from anti-influenza_Chain
  source 1..327: mol_type = other RNA
gacatcgtcatgacccagccccccgccaccctctccgtctcccccggcgagcgcgccaccctctcctgcggcgcctcccagggcctcggctccaacctcgcctggtaccagcagaagcccggccaggccccccgcctcctcatctacgccgcctccacccgcgccaccggcatcaccgcccgcttctccggctccggctccggcaccgagttcaccctcaccatcaactccctccagtccgaggacttcgccctctactactgccagcagtacacctactggcccctcaccttcggcggcggcaccaaggtcgagatcaagcgcacc

SEQ ID NO: 20077 - RNA, 327 nt, synthetic construct
  misc_feature 1..327: note = derived and/or modified sequence opt2 from anti-influenza_Chain
  source 1..327: mol_type = other RNA
gacatcgtcctcacccagtcccccgccaccctctccgtctcccccggcgagcgcgccaccctctcctgccgcgcctcccagtccgtcaaccgcaacctcgcctggttccagcagatccccggccaggccccccgcctcctcatcttcgacgcctccacccgcgccgccgacatccccgcccgcttctccggcggcggctccggcgccgagttcaccctcaccgtctcctccctccagcccgaggacttcgccgtctactactgccagcagtacgacaagtggccccccggcttcggccagggcaccaaggtcgagatcaagcgcacc

SEQ ID NO: 20078 - RNA, 330 nt, synthetic construct
  misc_feature 1..330: note = derived and/or modified sequence opt2 from anti-influenza_Chain
  source 1..330: mol_type = other RNA
cagtccgtcctcacccagcccccctccgcctccggcgcccccggccagcgcgtcaccctctcctgctccggctccggctccaacatcggctccaacaccgtctcctggtaccagcagctccccggcaccgcccccaagctcctcgtcttcaccaacaaccagcgcccctccggcgtccccgaccgcttctccggctccaagtccggcacctccgcctccctcgccatctccggcctccagtccgaggacgaggccgactactactgcgccgcctgggacgactccctcaacggccagctcttcggcggcggcaccaagctcaccgtcctc

SEQ ID NO: 20079 - RNA, 330 nt, synthetic construct
  misc_feature 1..330: note = derived and/or modified sequence opt2 from anti-influenza_Chain
  source 1..330: mol_type = other RNA
cagtccgtcctcacccagcccccctccgtctccgccgcccccggccagcgcgtcaccatctcctgctccggcacctcctccaacatcggcaagaactacgtctcctggtaccagcagctccccggcgccgcccccaagctcctcatctacgacaacgacaagcgcccctccggcatccccgaccgcttctccggctccaagtccggcacctccgccaccctcggcatcaccggcctccagaccggcgacgaggccgactactactgcggcacctgggactcctccctctccgtcggcatgttcggcggcggcacccgcctcaccgtcctc

SEQ ID NO: 20080 - RNA, 330 nt, synthetic construct
  misc_feature 1..330: note = derived and/or modified sequence opt2 from anti-influenza_Chain
  source 1..330: mol_type = other RNA
gagaccaccctcacccagtcccccgccaccctctccgtctcccccggcgagcgcgccaccctctcctgccgcgcctcccagtccgtctcccgcaacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctcctccatcaccttcggccagggcacccgcctcgagatcaagcgcaccgtc

SEQ ID NO: 20081 - RNA, 330 nt, synthetic construct
  misc_feature 1..330: note = derived and/or modified sequence opt2 from anti-influenza_Chain
  source 1..330: mol_type = other RNA
cagtccgtcctcacccagcccccctccgcctccggcacccccggccagcgcgtcaccatctcctgctccggctcctcctccaacatcggctccaacaccgtcaactggtacaagcagctccccggcaccgccccccgcctcctcatctactccaacgaccagcgcccctccggcgtccccgaccgcttctccggctccaagtccggcacctccgcctccctcgccatctccggcctccagtccgaggacgaggccaactactactgcgccgcctgggacgactccctctccggctgggtcttcggcggcggcaccaagctcaccgtcctc

SEQ ID NO: 20082 - RNA, 330 nt, synthetic construct
  misc_feature 1..330: note = derived and/or modified sequence opt2 from anti-influenza_Chain
  source 1..330: mol_type = other RNA
cagtccgccctcacccagccccgctccgtctccggctcccccggccagtccgtcaccatctcctgcaccggctcctcctccgacgtcggcgcctccaactccgtctcctggtaccagcagcaccccggcaaggcccccaagctcgtcatctacgacgtcaccgagcgcccctccggcgtcccccaccgcttctccggctccaagtccggcaacaccgcctccctcaccgtctccggcctccagcccgaggacgaggccgactacttctgctgcgcctacggcggcaagtacctcgtcgtcttcggcggcggcaccaaggtcaccgtcctc

SEQ ID NO: 20083 - RNA, 330 nt, synthetic construct
  misc_feature 1..330: note = derived and/or modified sequence opt2 from anti-influenza_Chain
  source 1..330: mol_type = other RNA
cagtccgccctcacccagcccgcctccgtctccggctcccccggccagtccatcaccatctcctgcaccggcacctcctccgacgtcggcggctacaactacgtctcctggtaccagcagcaccccggcaaggcccccaagctcctcatctacgaggtcaccaactggccctccggcgtctccaaccgcttctccggctccaagtccggcaacaccgcctccctcaccatctccggcctccaggccgaggacgaggccgactactactgctcctcctacgccggctcctccacctgggtcttcggcggcggcacccgcgtcaccgtcctc

SEQ ID NO: 20084 - RNA, 330 nt, synthetic construct
  misc_feature 1..330: note = derived and/or modified sequence opt2 from anti-influenza_Chain
  source 1..330: mol_type = other RNA
cagaccgtcgtcacccaggagccctccctcaccgtctcccccggcggcaccgtcaccctcacctgcgcctcctccaccggcgccgtcacctcctcctacttccccaactggttccagcagaagcccggccaggccccccgccccctcatctactccaccaccatccgccactcctggacccccgcccgcttctccggctccctcctcggcggcaaggccgccctcaccctctccggcgtccagcccgaggacgaggccgactactactgcctcctctactccggcggcgaccccgtcgccttcggcggcggcaccaagctcaccgtcctc

SEQ ID NO: 20085 - RNA, 330 nt, synthetic construct
  misc_feature 1..330: note = derived and/or modified sequence opt2 from anti-influenza_Chain
  source 1..330: mol_type = other RNA
cagtccgtcctcacccagtccccctccgtctccgccgcccccggccagaaggtcaccatctcctgctccggctccgactccaacatcggcgactacttcgtctgctggtaccagcacctccccggcaagcccccccagctcctcatctacgagaacaacaagcgcccctccggcatccccgaccgcttctccggctccaagtccggcacctccgccaccctcggcatcaccggcatccagaccggcgacgaggccgactactactgcgccacctgggacggctccctctccgcctgggtcttcggcggcggcaccaagctcaccgtcctc

SEQ ID NO: 20086 - RNA, 330 nt, synthetic construct
  misc_feature 1..330: note = derived and/or modified sequence opt2 from anti-influenza_Chain
  source 1..330: mol_type = other RNA
cagtccgccctcacccagccccgctccgtctccggctcccccggccagtccatcaccatctcctgcaccggcggctcctccgacatcggcgcctccaactccgtctcctggtaccagcagcaccccggcaaggcccccaagctcgtcatcttcgacgtcaccgagcgcccctccggcgtcccccaccgcttctccggctccaagtccggcaacaccgcctccctcaccgtctccggcctccagcccgacgacgaggccgactacttctgctgcgcctacggcggcaagtacctcgtcgtcttcggcggcggcaccaaggtcaccgtcctc

SEQ ID NO: 20087 - RNA, 330 nt, synthetic construct
  misc_feature 1..330: note = derived and/or modified sequence opt2 from anti-influenza_Chain
  source 1..330: mol_type = other RNA
caggccgtcgtcacccaggagccctccctcgccgtctcccccggcggcaccgtcaccctcacctgcggctcctccaccggcgccgtcacccgcggccactacccctactggttccagcagaagcccggccaggccccccgcgccctcatctacgactccgccggcaaccgccactcctggacccccgcccgcttctccggctccctcctcggcggcaaggccgccctcaccctctccggcgcccagcccgaggacgaggccgagtactactgcctcctctcctactccggcgtctgggtcttcggcggcggcaccaagctcaccgtcctc

SEQ ID NO: 20088 - RNA, 330 nt, synthetic construct
  misc_feature 1..330: note = derived and/or modified sequence opt2 from anti-influenza_Chain
  source 1..330: mol_type = other RNA
gagatcgtcatgacccagtcccccgccaccctctccgtctcccccggcgagcgcgtcaccctctcctgccgcgcctcccagtccatcaccgacggcctcgcctggtaccagcagaagtccggccaggccccccgcctcctcatctacggcgcctccacccgcgccaccggcatccccgcccgcttctccggctccggctccggcaccgagttcaccctcaccatctcctccctccagtccgaggacttcgccgtctactactgccagcagtacaacaactggccccccgtcaccttcggccagggcaccaaggtcgagatcaagcgcacc

SEQ ID NO: 20089 - RNA, 330 nt, synthetic construct
  misc_feature 1..330: note = derived and/or modified sequence opt2 from anti-influenza_Chain
  source 1..330: mol_type = other RNA
tcctccgagctcacccagcccccctccgcctccggcacccccggccagcgcgtcaccatctcctgctccggctccacctccaacatcggctacaaccccgtctcctggtaccagcaggtccccggcaccgcccccaagctcctcatctactccaacaccgagcgcccctccggcgtccccgaccgcttctccggctccaagtccggcacctccgcctccctcgccatctccggcctccagtccgaggacgaggccgactactactgcgccgcctgggacgacaccctcaacggccccgtcttcggcggcggcaccaaggtcaccgtcctc

SEQ ID NO: 20090 - RNA, 330 nt, synthetic construct
  misc_feature 1..330: note = derived and/or modified sequence opt2 from anti-influenza_Chain
  source 1..330: mol_type = other RNA
cagtccgccctcacccagcccgcctccgtctccggctcccccggccagtccatcaccatctcctgcaccggcacctcctccgacgtcggcggctacaactacgtctcctggtaccagcagcaccccggcgaggcccccaagctcatgatctccgacgtctccaaccgcccctccggcgtctccaaccgcttctccggctccaagtccggcaacaccgcctccctcaccatctccggcctccaggccgaggacgaggccgactactactgcacctcctacacctcctccaacaccctcgtcttcggcggcggcaccaagctcaccgtcctc

SEQ ID NO: 20091 - RNA, 330 nt, synthetic construct
  misc_feature 1..330: note = derived and/or modified sequence opt2 from anti-influenza_Chain
  source 1..330: mol_type = other RNA
cagtccgtcctcacccagcccccctccgtctccgccgcccccggccagaaggtcaccatctcctgctccggctcctcctccaacatcggccacaacttcgtctcctggtaccagcagctccccgccaccgcccccaagctcctcatctacgacaccgacaagcgcccctccggcatccccgaccgcttctccggctccaagtccggcacctccgccaccctcggcatcaccggcctccagaccggcgacgaggccgactactactgcggcacctgggactcctccctctcctccgtcatcttcggcggcggcaccaagctcaccgtcctc

SEQ ID NO: 20092 - RNA, 330 nt, synthetic construct
  misc_feature 1..330: note = derived and/or modified sequence opt2 from anti-influenza_Chain
  source 1..330: mol_type = other RNA
gacatccagatgacccagtccccctccaccctctccgcctccgtcggcgaccgcgtcaccatcacctgccgcgcctcccagaccatcaacaactacctcgcctggtaccagcagaagcccggcaaggcccccaagctcctcatctacaaggcctcctccctcgagtccggcgtcccctcccgcttctccggctccggctccggcaccgagttcaccctcaccatctcctccctccagcccgacgacttcgccacctactactgccaggagtacaacaacgactcccccctcaccttcggcggcggcaccaaggtcgagatcaagcgcacc

SEQ ID NO: 20093 - RNA, 330 nt, synthetic construct
  misc_feature 1..330: note = derived and/or modified sequence opt2 from anti-influenza_Chain
  source 1..330: mol_type = other RNA
gacatcgagctcacccaggacccctccgtctccgtcgcccccggccagaccgcccgcatcccctgcgtccgcttcaacatgggccccacctccgtccactggtaccagcagaagcccggccaggcccccgtcctcgtcgtctacgacgactccgaccgcccctccggcatccccgagcgcttctccggctccaactccggcgactccgccaccctcaccatctcccgcgtcgaggccggcgacgaggccgactactactgccaggtctgggacatgtcctccgaccgccgcgtcttcggcggcggcaccaccctcaccgtcctcggccag

SEQ ID NO: 20094 - RNA, 330 nt, synthetic construct
  misc_feature 1..330: note = derived and/or modified sequence opt2 from anti-influenza_Chain
  source 1..330: mol_type = other RNA
gacatcgtcatgacccagtcccccggcaccctctccctctcccccggcgagcgcgccaccctctactgccgcgcctcccagtccgtccgctccggctacctcgcctggtaccagcacaagcccggccaggcccccctcctcctcttctacgacgcctccggccgcgccaccggcatccccgaccgcttctccggctccggctccggcaccgacttcaccctcaccatctcccgcctcgagcccgaggacttcgccgtctactactgcctccagtacggctcctccccccgcaccttcggccagggcaccaaggtcgagatcaagcgcacc

SEQ ID NO: 20095 - RNA, 330 nt, synthetic construct
  misc_feature 1..330: note = derived and/or modified sequence opt2 from anti-influenza_Chain
  source 1..330: mol_type = other RNA
gacatcgtcctcacccagtccccctccttcctctccgcctccgtcggcgaccgcgtcaccatcacctgccgcgcctcccagctcatctcctcctacttcgcctggtaccagcagaagcccggcaagccccccaagctcctcatctacgccgcctccaccctccagtccggcgtcccctcccgcttctccggctccggctccggcacccagttctccctcaccatctcctccctccagcccgaggacttcgccacctactactgccagcagctcaactcctacccccccatcaccttcggccagggcacccgcctcgagatcaagcgcacc

SEQ ID NO: 20096 - RNA, 330 nt, synthetic construct
  misc_feature 1..330: note = derived and/or modified sequence opt2 from anti-influenza_Chain
  source 1..330: mol_type = other RNA
gacatcaccctcacccagtcccccgccaccctctccgtctcccccggcgagcgcgccaccctctcctgccgcgcctcccagtccgtctcctccaacctcgcctggtaccagcagaagcccggccaggccccccgcctcctcatctacggcgcctccaaccgcgccaccgacatccccgcccgcttctccggctccggctccggcaccgagttcaccctcaccatctcctccctccagtccgaggacttcgccgtctactactgccagcagttcaacgactggcccttcctcaccttcggcggcggcaccaaggtcgagatcaagcgcacc

SEQ ID NO: 20097 - RNA, 330 nt, synthetic construct
  misc_feature 1..330: note = derived and/or modified sequence opt2 from anti-influenza_Chain
  source 1..330: mol_type = other RNA
gacatcgtcatgacccagtccccctccttcctctccgcctccgtcggcgaccgcgtcaccatcacctgccgcacctcccaggtcatctcctcctacctcgcctggtaccagcagcgccccggcaaggcccccaagctcctcatctacgccgcctccaccctccagtccggcgtcccctcccgcttctccggctccggctccggcacccgcttctccctcaccatctccaacctccagcccgaggacttcgccacctacttctgccagcagctcaccacctacccccccatcaccttcggccagggcacccgcctcgagatcaagcgcacc

SEQ ID NO: 20098 - RNA, 330 nt, synthetic construct
  misc_feature 1..330: note = derived and/or modified sequence opt2 from anti-influenza_Chain
  source 1..330: mol_type = other RNA
gacatcgtcctcacccagtccccctccgtctccgtcgcccccggccagaccgcccgcatcacctgcggcggcaacgacatcggctccaagtccgtccactggtaccagcagaagcccggccaggcccccgtcctcgtcgtcttcgacgaccgcgaccgcccctccggcatccccgagcgcttctccggctccaactccggcaacaccgccaccctcaccatctcccgcgtcgaggccggcgacgaggccgactactactgccaggtctgggacatcacctccgacctcgtcgtcttcggcggcggcaccaagctcaccgtcgtcggccag

SEQ ID NO: 20099 - RNA, 330 nt, synthetic construct
  misc_feature 1..330: note = derived and/or modified sequence opt2 from anti-influenza_Chain
  source 1..330: mol_type = other RNA
gacatcgtcatgacccagccccccggcaccctctccgtctcccccggcgagcgcgccaccctctcctgccgcgcctcccagtccgtctccaccaacctcgcctggtaccagcagaagcccggccaggccccccgcctcctcatccacggcgcctccacccgcgccaccggcatccccgcccgcttctccggctccggctccggcgccgagttcaccctcaccatctcctccctccagtccgaggacgtcgccgtctactactgccagcagtacgacaactggctccccatcaccttcggccccggcaccaaggtcgacatccagcgcacc

SEQ ID NO: 20100 - RNA, 330 nt, synthetic construct
  misc_feature 1..330: note = derived and/or modified sequence opt2 from anti-influenza_Chain
  source 1..330: mol_type = other RNA
gaccccatgctcacccagaccgcctcccccgtctccgccgccgtcggcggcaccgtcaccatcaactgccaggcctcccagtccgtctacaacaagaacaacctcgcctggtaccagcagaagctcggccagccccccaagctcctcatctacgccgcctccaccctcacctccggcgtcccctcccgcttcaagggctccggctccggcacccagttcaccctcaccatctccgacctcgagtgcgacgacgccgccacctactactgcgccggcgactactccggcggcatctacgccttcggcggcggcaccaaggtcgagatcaag

SEQ ID NO: 20101 - RNA, 330 nt, synthetic construct
  misc_feature 1..330: note = derived and/or modified sequence opt2 from anti-influenza_Chain
  source 1..330: mol_type = other RNA
gagctcgtcatgacccagacccccgcctccgtctccgccgccgtcggcggcaccgtcaccatctcctgccagtcctccgagtccgtctacaagaacaacaacctcgcctggttccagcagaagctcggccagccccccaagctcctcatctacgacgcctccaagctcgcctccggcgtcccctcccgcttctccggctccggctccggcacccagttcaccctcaccatctccgacctcgagtgcgacgacgccgccacctactactgcgccggcgactactccggctccaactacgccttcggcggcggcaccaagctcgagatcaag

SEQ ID NO: 20102 - RNA, 330 nt, synthetic construct
  misc_feature 1..330: note = derived and/or modified sequence opt2 from anti-influenza_Chain
  source 1..330: mol_type = other RNA
gagcccatgctcacccagaccgcctcctccgtctccgccgccgtcggcggctccgtcaccatctcctgccagtcctcccagtccgtcgactccaacaaccagctctcctggtaccagcagaagcccggccagccccccaagctcctcatctacgccgcctccaccctcacctccggcgtcccctcccgcttcaagggctccggctccggcacccagttcaccctcaccatctccgacctcgagtgcgacgacgccgccacctactactgcgccggcgactactccggcggcatctacgccttcggcggcggcaccgaggtcgtcgtcaag

SEQ ID NO: 20103 - RNA, 330 nt, synthetic construct
  misc_feature 1..330: note = derived and/or modified sequence opt2 from anti-influenza_Chain
  source 1..330: mol_type = other RNA
gaccccatgctcacccagaccgccgcctccgtctccgccgccgtcggcggcaccgtcaccatctcctgccagtcctccgagtccgtctacaagaacaacaacctcgcctggttccagcagaagctcggccagccccccaccctcctcatctgggacgcctccaagctcgcctccggcgtcccctcccgcttctccggctccggctccggcacccagttcaccctcaccatctccgacctcgagtgcgacgacgccgccacctactactgcgccggcgactactccggcgtcaactacgccttcggcggcggcaccgaggtcgtcgtcaag

SEQ ID NO: 20104 - RNA, 330 nt, synthetic construct
  misc_feature 1..330: note = derived and/or modified sequence opt2 from anti-influenza_Chain
  source 1..330: mol_type = other RNA
gagctcgtcatgacccagacccccgcctccgtctccgccgccgtcggcggcaccgtcaccatctcctgccagtcctccgagtccgtctacaagaacaacaacctcgcctggttccagcagaagctcggccagccccccaagctcctcatctacgacgcctccaagctcgcctccggcgtcccctcccgcttctccggctccggctccggcacccagttcaccctcaccatctccgacctcgagtgcgacgacgccgccacctactactgcgccggcgactactccggctccaactacgccttcggcggcggcaccgaggtcgtcgtcaag

SEQ ID NO: 20105 - RNA, 330 nt, synthetic construct
  misc_feature 1..330: note = derived and/or modified sequence opt2 from anti-influenza_Chain
  source 1..330: mol_type = other RNA
gaccccatgctcacccagaccgcctcctccgtctccgccaccgtcggcggcaccgtcaccatctcctgccagtcctcccagtccgtcgacaacaacaaggacctcgcctggttccagcagaagcccggccactcccccaagctcctcatctacttcgcctcccgcctcgcctccggcgtcccctcccgcttcaagggctccggctccggcacccacttcaccctcaccatctccgacctcgagtgcgacgacgccgccacctactactgcgccggcgactactccggcgccaactacgccttcggcggcggcaccaagctcgagatcaag

SEQ ID NO: 20106 - RNA, 330 nt, synthetic construct
  misc_feature 1..330: note = derived and/or modified sequence opt2 from anti-influenza_Chain
  source 1..330: mol_type = other RNA
gaccccatgctcacccagaccgcctcccccgtctccgccgccgtcggcggcaccgtcaccatcaactgccagtcctcccagtccgtctacaacaacaaccgcctctcctggttccagcagaagcccggccagccccccaagctcctcatctactccgcctccaccctcgcctccggcgtctcctcccgcttcaagggctccggctccggcacccagttcaccctcaccatctccgacctcgagtgcgacgacgccgccacctactactgcgccggcgactactccggcggcatctacgccttcggcggcggcaccgagctcgagatcctc

SEQ ID NO: 20107 - RNA, 330 nt, synthetic construct
  misc_feature 1..330: note = derived and/or modified sequence opt2 from anti-influenza_Chain
  source 1..330: mol_type = other RNA
gagctcgtcctcacccagacccccgcctccgtctccgccgccgtcggcggcaccgtctccatctcctgccagtcctcccagtccgtctacaagaacaacaacctcgcctggttccagcagaagctcggccagccccccaccctcctcatctgggacgcctccaagctcgcctccggcgtcccctcccgcttctccggctccggctccggcacccagttcaccctcaccatctccgacctcgagtgcgacgacgccgccacctactactgcgccggcgactactccggcgtcaactacgccttcggcggcggcaccaagctcgagatcaag

SEQ ID NO: 20108 - RNA, 330 nt, synthetic construct
  misc_feature 1..330: note = derived and/or modified sequence opt2 from anti-influenza_Chain
  source 1..330: mol_type = other RNA
gagctcgacctcacccagacccccgcctccgtctccgccgccgtcggcggcaccgtcaccatctcctgccagtcctccgagtccgtctacaagaacaacaacctcgcctggttccagcagaagctcggccagccccccaccctcctcatctgggacgcctccaagctcgcctccggcgtcccctcccgcttctccggctccggctccggcacccagttcaccctcaccatctccgacctcgagtgcgacgacgccgccacctactactgcgccggcgactactccggcgtcaactacgccttcggcggcggcaccgaggtcgtcgtcaag

SEQ ID NO: 20109 - RNA, 330 nt, synthetic construct
  misc_feature 1..330: note = derived and/or modified sequence opt2 from anti-influenza_Chain
  source 1..330: mol_type = other RNA
gacatccagatgacccagtccccctcctccctctccgcctccgtcggcgaccgcgtcaccatcacctgccagtcctccgagtccgtctacaagaacaacaacctcgcctggtaccagcagaagcccggcaagccccccaagctcctcatctgggacgcctccaagctcgcctccggcgtcccctcccgcttctccggctccggctccggcaccgacttcaccctcaccatctcctccctccagcccgaggacgtcgccacctactactgcgccggcgactactccggcgtcaactacgccttcggcggcggcaccgaggtcgtcgtcaag

SEQ ID NO: 20110 - RNA, 333 nt, synthetic construct
  misc_feature 1..333: note = derived and/or modified sequence opt2 from anti-influenza_Chain
  source 1..333: mol_type = other RNA
gacatcgtcatgacccagtcccccgactccctcgccgtctccctcggcgagcgcgccaccatcaactgcaagtcctcccagtccgtcaccttcaacaacaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagcactaccgcaccccccccaccttcggccagggcaccaaggtcgagatcaag

SEQ ID NO: 20111 - RNA, 333 nt, synthetic construct
  misc_feature 1..333: note = derived and/or modified sequence opt2 from anti-influenza_Chain
  source 1..333: mol_type = other RNA
cagtccgccctcacccagcccgcctccgtctccggctcccccggccagtccatcaccatctcctgcaccggcaccggctccgacgtcggctcctccaacctcgtctcctggtaccagcagcaccccgccaaggcccccaagctcatcatctacgaggtcaccaagcgcccctccggcgtctccaaccgcttctccggctccaagtccggcaacaccgcctccctcaccatctccggcctccaggccgaggacgaggccgactactactgctgctcctacgccggctcctcctcctcccgcgtcttcggcaccggcaccaaggtcaccgtcctc

SEQ ID NO: 20112 - RNA, 333 nt, synthetic construct
  misc_feature 1..333: note = derived and/or modified sequence opt2 from anti-influenza_Chain
  source 1..333: mol_type = other RNA
cagtccgtcctcacccagcccccctccgcctccggcacccccggccagcgcgtcaccatctcctgctccggctccacctccaacatcggctccaacgccgtcaactggtaccagcagctccccggcaccgcccccaagctcctcatctactccaacaaccagcgcccctccggcgtccccgaccgcttctccggctccaagtccggcacctccgcctccctcgccatctccggcctccagtccgaggacgaggccgactactactgcgccgcctgggacgactccctctccggctcctgggtcttcggcggcggcaccaagctcaccgtcctc

SEQ ID NO: 20113 - RNA, 333 nt, synthetic construct
  misc_feature 1..333: note = derived and/or modified sequence opt2 from anti-influenza_Chain
  source 1..333: mol_type = other RNA
gagaccaccctcacccagtcccccggcaccctctccctctcccccggcgagcgcgccaccctctcctgccgcgtctcccagtccgtctcctccaactacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggcacctccccccgcgccttcggccacggcaccaaggtcgagatcaagcgcaccgtc

SEQ ID NO: 20114 - RNA, 333 nt, synthetic construct
  misc_feature 1..333: note = derived and/or modified sequence opt2 from anti-influenza_Chain
  source 1..333: mol_type = other RNA
cagtccgtcctcacccagcccccctccgtctccggcgcccccggccagcgcgtcaccatctcctgcggcggctcccgctccaacatcggcgccggctacgacgtccactggtaccagcagttccccggcaccgcccccaaggtcgtcatctacggcaacaacaaccgcccctccggcgtccccgaccgcttctccggctccaagtccggcacctccgcctccctcgccatcaccggcctccaggccgaggacgaggccaactactactgccagtcctacgacaccaacctcggcggctccatcttcggcggcggcacccaggtcaccgtcctc

SEQ ID NO: 20115 - RNA, 333 nt, synthetic construct
  misc_feature 1..333: note = derived and/or modified sequence opt2 from anti-influenza_Chain
  source 1..333: mol_type = other RNA
aacttcatgctcacccagccccactccgtctccgagtcccccggcaagaccgtcaccatctcctgcaccggctcctccggctccatcgcctccaactacgtccagtggtaccagcagcgccccggctccgcccccaccaccgtcatctacgaggactaccagcgcccctccggcgtccccgaccgcttctccggctccatcgactcctcctccaactccgcctccctcaccatctccggcctcaagaccgaggacgaggccgactactactgccagtcctacgacgactccgaccacctcatcttcggcggcggcaccaagctcaccgtcctc

SEQ ID NO: 20116 - RNA, 333 nt, synthetic construct
  misc_feature 1..333: note = derived and/or modified sequence opt2 from anti-influenza_Chain
  source 1..333: mol_type = other RNA
cagtccatgctcacccagcccccctccgcctccggcacccccggccagcgcgtcaccatctcctgctccggctcctcctccaacatcggctccaacaccgtcaactggttcaagcacctccccggcaccgcccccaagctcctcatctaccgcaacgacctccgcccctccggcgtccccgaccgcttctccggctccaagtccggcacctccgcctccctcgccatctccggcctccagtccgaggacgaggccgactactactgcgccacctgggacgactccctcaacggcttctacgtcttcggcaccggcaccaaggtcaccgtcctc

SEQ ID NO: 20117 - RNA, 333 nt, synthetic construct
  misc_feature 1..333: note = derived and/or modified sequence opt2 from anti-influenza_Chain
  source 1..333: mol_type = other RNA
gacatccagctcacccagtccccctcctccctctccgcctccgccggcgaccgcgtctccatgacctgccgcgcctcccagatcatctcctcctccctcaactggtaccagcagaagcccggcaaggcccccaagctcctcatctacgccgcctccaacctccagtccggcgtcccctcccgcttctccggctccggctccggcaccgacttcaccctcaccatctcctccctccagcccgaggacttcgccacctactactgccagcagtcctactccaccccccccgagctcaccttcggcggcggcaccaaggtcgacatcaagcgcacc

SEQ ID NO: 20118 - RNA, 333 nt, synthetic construct
  misc_feature 1..333: note = derived and/or modified sequence opt2 from anti-influenza_Chain
  source 1..333: mol_type = other RNA
tcctacgtcctcacccagcccccctccgcctccggcacccccggccagcgcgtcaccatctcctgctccggctccaccttcaacatcggctccaacgccgtcgactggtaccgccagctccccggcaccgcccccaagctcctcatctactccaacaaccagcgcccctccggcgtccccgaccgcttctccggctcccgctccggcacctccgcctccctcgccatctccggcctccagtccgaggacgaggccgactactactgcgccgcctgggacgacatcctcaacgtccccgtcttcggcggcggcaccaagctcaccgtcctcggc

SEQ ID NO: 20119 - RNA, 333 nt, synthetic construct
  misc_feature 1..333: note = derived and/or modified sequence opt2 from anti-influenza_Chain
  source 1..333: mol_type = other RNA
cagtccgccctcacccagcccgccgccgtctccggctcccccggccagtccatcaccatctcctgcaccggcacctcctccgacgtcggcggctacaactacgtctcctggtaccagcagcaccccggcaaggcccccaagctcatgatctacgaggtctccaaccgcccctccggcgtctccaaccgcttctccggctccaagtccggcaacaccgcctccctcaccatctccggcctccaggccgaggacgaggccgactactactgctcctcctacacctcctcctccacctacgtcttcggcaccggcaccaaggtcaccgtcctcggc

SEQ ID NO: 20120 - RNA, 333 nt, synthetic construct
  misc_feature 1..333: note = derived and/or modified sequence opt2 from anti-influenza_Chain
  source 1..333: mol_type = other RNA
tcctacgtcctcacccagcccccctccgtctccggcacccccggccagcgcgtcaccatctcctgctccggctcccgctccaacgtcggcgacaactccgtctactggtaccagcacgtccccgagatggcccccaagctcctcgtctacaagaacacccagcgcccctccggcgtccccgcccgcttctccggctccaagtccggcacctccgcctccctcgccatcatcggcctccagtccggcgacgaggccgactactactgcgtcgcctgggacgactccgtcgacggctacgtcttcggctccggcaccaaggtcaccgtcctcggc

SEQ ID NO: 20121 - RNA, 333 nt, synthetic construct
  misc_feature 1..333: note = derived and/or modified sequence opt2 from anti-influenza_Chain
  source 1..333: mol_type = other RNA
tccgtcctcacccagcccccctccgtctccgccgcccccggccagaaggtcaccatctcctgctccggctcctcctccaacatcggcaacgactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccaactactactgcgccacctgggaccgccgccccaccgcctacgtcgtcttcggcggcggcaccaagctcaccgtcctcggc

SEQ ID NO: 20122 - RNA, 333 nt, synthetic construct
  misc_feature 1..333: note = derived and/or modified sequence opt2 from anti-influenza_Chain
  source 1..333: mol_type = other RNA
cagtccgccctcacccagccccgctccgtctccggctcccccggccagtccgtcaccatctcctgcaccggcacctcctccgacgtcggcggctacaactacgtctcctggtaccagcagcaccccggcaaggcccccaagctcatgatctacgacgtctccaagcgcccctccggcgtccccgaccgcttctccggctccaagtccggcaacaccgcctccctcaccatctccggcctccaggccgaggacgaggccgactactactgctcctcctacacctcctcctccacccacgtcttcggcaccggcaccaaggtcaccgtcctcggc

SEQ ID NO: 20123 - RNA, 333 nt, synthetic construct
  misc_feature 1..333: note = derived and/or modified sequence opt2 from anti-influenza_Chain
  source 1..333: mol_type = other RNA
tcctacgtcctcacccagcccccctccgcctccggcacccccggccagcgcgtcaccatctcctgctccggctcctcctccaacatcggctccaactacgtctactggtaccagcagctccccggcaccgcccccaagctcctcatctaccgcgacggccagcgcccctccggcgtccccgaccgcttctccggctccaagtccggcacctccgcctccctcgccatctccggcctccgctccgacgacgaggccgactactactgcgccacctgggacgacaacctctccggccccgtcttcggcggcggcaccaagctcaccgtcctcggc

SEQ ID NO: 20124 - RNA, 333 nt, synthetic construct
  misc_feature 1..333: note = derived and/or modified sequence opt2 from anti-influenza_Chain
  source 1..333: mol_type = other RNA
cagtccgccctcacccagcccgcctccgtctccggctcccccggccagtccatcaccatctcctgcaccggcacctcctccgacgtcggcggctacaactacgtctcctggtaccagcagcaccccggcaaggcccccaagctcatgatctacgaggtctccaaccgcccctccggcgtctccaaccgcttctccggctccaagtccggcaacaccgcctccctcaccatctccggcctccaggccgaggacgaggccgactactactgctcctcctacacctcctcctccaccctcgtcttcggcaccggcaccaaggtcaccgtcctcggc

SEQ ID NO: 20125 - RNA, 333 nt, synthetic construct
  misc_feature 1..333: note = derived and/or modified sequence opt2 from anti-influenza_Chain
  source 1..333: mol_type = other RNA
accgtcctcacccagcccccctccgtctccggcgcccccggccagcgcgtcaccatctcctgcaccggctcctcctccaacatcggcgccggctacgacgtccactggtaccagcagctccccggcaccgcccccaagctcctcatctacggcaactccaaccgcccctccggcgtccccgaccgcttctccggctccaagtccggcacctccgccaccctcggcatcaccggcctccagaccggcgacgaggccgactactactgcggcacctgggactcctccctctccgcctacgtcttcggcaccggcaccaaggtcaccgtcctcggc

SEQ ID NO: 20126 - RNA, 333 nt, synthetic construct
  misc_feature 1..333: note = derived and/or modified sequence opt2 from anti-influenza_Chain
  source 1..333: mol_type = other RNA
ggctccgccctcacccagccccgctccgtctccggctcccccggccagtccgtcaccatctcctgcaccggcacctcctccgacgtcggcggctacaactacgtctcctggtaccagcagcaccccggcaaggcccccaagctcatgatctacgacgtctccaagcgcccctccggcgtccccgaccgcttctccggctccaagtccggcaacaccgcctccctcaccatctccggcctccaggccgaggacgaggccgactactactgctcctcctacacctcctcctccacccacgtcttcggcaccggcaccaaggtcaccgtcctcggc

SEQ ID NO: 20127 - RNA, 333 nt, synthetic construct
  misc_feature 1..333: note = derived and/or modified sequence opt2 from anti-influenza_Chain
  source 1..333: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatcttcggcgcctccacccgcgccaccggcatccccgaccgcttctccggctccggctccggcaccgacttcaccctcaccatctcccgcctcgagcccgaggacttcgccgtcttctactgccagcagtacggctccctccccctcaccttcggcggcggcaccaaggtcgagatcaagggcaccgtc

SEQ ID NO: 20128 - RNA, 333 nt, synthetic construct
  misc_feature 1..333: note = derived and/or modified sequence opt2 from anti-influenza_Chain
  source 1..333: mol_type = other RNA
gagatcgtcctcacccagtcccccggcaccctctccctctcccccggcgagcgcgccaccctctcctgccgcgcctcccagtccgtccgctccaacaacctcgcctggtaccagcacaagcccggccaggccccccgcctcctcatcttcggcgcctcctcccgcgccaccggcatccccgaccgcttctccggctccggctccggcaccgacttcaccctcaccatctcccgcctcgagcccgaggacttcgccgtctactactgccagcagtacggctcctcccccgccctcaccttcggcggcggcaccaaggtcgagatcaagcgcacc

SEQ ID NO: 20129 - RNA, 333 nt, synthetic construct
  misc_feature 1..333: note = derived and/or modified sequence opt2 from anti-influenza_Chain
  source 1..333: mol_type = other RNA
cagtccctcgaggagtccggcggcggcctcgtcaagcccggcggctccctcaccctcacctgcaccgtctccggcctctccctctactccaacgagatcaactgggtccgccaggcccccggcaacggcctcgagtggatcggcgccatcgccggctccggctccgccgactacgcctcctgggccaagggccgctccaccatcacccgcaacaccgacctcaacaccgtcaccctcaagatgacctccctcaccgccgccgacaccgccacctacttctgcgcctccttctgggacctctggggccccggcaccctcgtcaccgtctcctcc

SEQ ID NO: 20130 - RNA, 333 nt, synthetic construct
  misc_feature 1..333: note = derived and/or modified sequence opt2 from anti-influenza_Chain
  source 1..333: mol_type = other RNA
cagtccgtcgaggagtccggcggcggcctcgtcaagcccggcggctccctcaccctcacctgcaccgtctccggcctctccctctactccaacgagatcaactgggtccgccaggcccccggcaacggcctcgagtggatcggcgccatcgccggctccggctccgccgactacgcctcctgggccaagtcccgctccaccatcacccgcaacaccaacctcaacaccgtcaccctcaagatgacctccctcaccgccgccgacaccgccacctacttctgcgcctccttctgggacctctggggccccggcaccctcgtcaccgtctcctcc

SEQ ID NO: 20131 - RNA, 333 nt, synthetic construct
  misc_feature 1..333: note = derived and/or modified sequence opt2 from anti-influenza_Chain
  source 1..333: mol_type = other RNA
cagtccctcgaggagtccggcggcggcctcgtcaagcccggcggctccctcaccctcacctgcaccgtctccggcctctccctctactccaacgagatcaactgggtccgccaggcccccggcaacggcctcgagtggatcggcgccatcgccggctccggctccgccgactacgcctcctgggccaagtcccgctccaccatcacccgcaacaccaacctcaacaccgtcaccctcaagatgacctccctcaccgccgccgacaccgccacctacttctgcgcctccttctgggacctctggggccccggcaccctcgtcaccgtctcctcc

SEQ ID NO: 20132 - RNA, 333 nt, synthetic construct
  misc_feature 1..333: note = derived and/or modified sequence opt2 from anti-influenza_Chain
  source 1..333: mol_type = other RNA
aacatcgtcctcacccagtcccccgcctccctcgccgtctccctcggccagcgcgccaccatctcctgccgcgcctccgagtccgtcgacatctacggcaactccttcatgcactggtaccagcagaagcccggccagccccccaagctcctcatctacctcgcctccaagctcgagtgcggcgtctgcgcccgcttcaacggctccggctgccgcaccgacttcaccctcgccatcgaccccgtcgagggcgacgacggcgccacctactactgccagcagaactacgaggacccctggaccttcggcggcggcaccaagctcgagatcaag

SEQ ID NO: 20133 - RNA, 333 nt, synthetic construct
  misc_feature 1..333: note = derived and/or modified sequence opt2 from anti-influenza_Chain
  source 1..333: mol_type = other RNA
aacatcgtcctcacccagtcccccgcctccctcgccgtctcccccggccagcgcgccaccatctcctgccgcgcctccgagtccatcgacatctacggcaactccttcatgcactggtaccagaagaagcccggccagccccccaagctcctcatctaccgcgcctccaacctcgagtccggcgtccccgcccgcttcaacggctccggctcccgcaccgacttcaccctcaccatcgaccccgtcgagggcgacgacggcgccacctactactgccagcagaactacgaggacccctggaccttcggcggcggcaccaagctcgagatcaag

SEQ ID NO: 20134 - RNA, 333 nt, synthetic construct
  misc_feature 1..333: note = derived and/or modified sequence opt2 from anti-influenza_Chain
  source 1..333: mol_type = other RNA
gagatcgtcctcacccagtcccccgccaccctctccctctaccccggcgagcgcgccaccctctcctgccgcgcctcccagtccgtctcccgctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggctcaagatcaccttcggccagggcacccgcctcgagatcaagggcaccgtc

SEQ ID NO: 20135 - RNA, 336 nt, synthetic construct
  misc_feature 1..336: note = derived and/or modified sequence opt2 from anti-influenza_Chain
  source 1..336: mol_type = other RNA
gacatcgtcatgacccagtcccccgactccctcgccgtctccctcggcgagcgcgccaccatcaactgcaagtcctcccagtccgtcctctactcctccaacaacaagaactacctcgcctggtaccagcagaagcccggccagccccccaagctcctcatcgactgggcctccacccgcgagtccggcgtccccgaccgcttctccggctccggctccggcaccgacttcaccctcaccatctccaacctccaggtcgaggacgtcgccgtctactactgccagcagtactaccgctccccctccttcggccagggcaccaagctcgagatcaag

SEQ ID NO: 20136 - RNA, 336 nt, synthetic construct
  misc_feature 1..336: note = derived and/or modified sequence opt2 from anti-influenza_Chain
  source 1..336: mol_type = other RNA
gacatcgtcatgacccagacccccctctccctctccgtcacccccggccagcccgcctccatctcctgcaagtcctcccagtccctcctccactccgacggcaagacctacctctactggtacctccagaagcccggccagtccccccagctcctcatctacgaggtctccaaccgcttctccggcgtccccgaccgcttctccggctccggctccggcaccgacttcaccctcaagatctcccgcgtcgaggccgaggacgtcggcgtctactactgcatgcagaacatcctcctccccctcaccttcggcggcggcaccaaggtcgagatcaag

SEQ ID NO: 20137 - RNA, 336 nt, synthetic construct
  misc_feature 1..336: note = derived and/or modified sequence opt2 from anti-influenza_Chain
  source 1..336: mol_type = other RNA
gagatcgtcatgacccagacccccctctccctctccgtcacccccggccagcccgcctccatctcctgccgctcctcccagtccctcctccactccgacggcaagacctacctctactggtacctccagaagcccggccagcccccccagctcctcatctccgaggtcttcaaccgcttctccggcgtccccgaccgcttctccggctccggctccggcaccgacttcaccctcaagatctcccgcgtcgaggccgaggacgtcggcgtctactactgcatgcagtccctccagctccccctcaccttcggcggcggcaccaaggtcgagatcaag

SEQ ID NO: 20138 - RNA, 336 nt, synthetic construct
  misc_feature 1..336: note = derived and/or modified sequence opt2 from anti-influenza_Chain
  source 1..336: mol_type = other RNA
gacatcgtcatgacccagtcccccctctccctccccgtcacccccggcgagcccgcctccatctcctgccgcgcctcccagtccctcctccactccaacggctacaactacctcgactggtacctccagaagcccggccagtccccccagctcctcatccagctcggctccacccgcgcctccggcgtccccgaccgcttctccggctccggctccggcaccgacttcaccctcgagatctcccgcgtcgaggccgaggacgtcggcgtctactactgcatgcaggccctccagctccccctcgccttcggccagggcacccgcctcgagatcaag

SEQ ID NO: 20139 - RNA, 336 nt, synthetic construct
  misc_feature 1..336: note = derived and/or modified sequence opt2 from anti-influenza_Chain
  source 1..336: mol_type = other RNA
gacatcgtcatgacccagtcccccctctccctccccgtctcccccggcgagcccgcctccatctcctgccgctcctcccagtccctcctccacggcaacggctacaactacctcgactggtacctccagaagcccggccagtccccccgcctcctcatctacctcggctccaaccgcgcctccggcgtccccgaccgcttctccggctccggctccggcaccgacttcaccctcaagatctcccgcgtcgaggccgaggacgtcggcgtctactactgcatgcaggccctccagacccccctcaccttcggcggcggcaccaaggtcgagatcaag

SEQ ID NO: 20140 - RNA, 336 nt, synthetic construct
  misc_feature 1..336: note = derived and/or modified sequence opt2 from anti-influenza_Chain
  source 1..336: mol_type = other RNA
cagtccgtcctcacccagcccccctccgtctccggcgcccccggccagcgcgtcaccatctcctgcaccggctcctcctccaacatcggcgccggctacgacgtccactggtaccagcagctccccggcaccgcccccaagctcctcatctacgacaacaacaaccgcccctccggcgtccccgaccgcttctccggctccaagtccggcgcctccgcctccctcgccatcaccggcctccaggccgaggacgaggcccactactactgccagtcctacgacaactccctctccggctccgtcttcggcggcggcacccagctcaccgtcctctcc

SEQ ID NO: 20141 - RNA, 336 nt, synthetic construct
  misc_feature 1..336: note = derived and/or modified sequence opt2 from anti-influenza_Chain
  source 1..336: mol_type = other RNA
cagtccgtcctcacccagcccccctccgtctccggcgcccccggccagcgcgtcaccatctcctgcaccggctcctcctccaacatcggctccgactacgacgtccactggtacaagcagctccccggcaccgcccccaagctcctcatcttcggcaactccaaccgcccctccggcgtccccgaccgcttctccggctccaagtccggcacctccgcctccctcgccatcaccggcctccaggccgaggacgaggccgactactactgccagtcctacgactcctccctctccggcttccacgtcttcggctccggcaccaaggtcaccgtcctc

SEQ ID NO: 20142 - RNA, 336 nt, synthetic construct
  misc_feature 1..336: note = derived and/or modified sequence opt2 from anti-influenza_Chain
  source 1..336: mol_type = other RNA
cagtccgtcctcacccagcccccctccgtctccgccgcccccggccagaaggtcaccatctcctgctccggctcctcctccaacatcggcaacgactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccaactactactgcgccacctgggaccgccgccccaccgcctacgtcgtcttcggcggcggcaccaagctcaccgtcctcggc

SEQ ID NO: 20143 - RNA, 336 nt, synthetic construct
  misc_feature 1..336: note = derived and/or modified sequence opt2 from anti-influenza_Chain
  source 1..336: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctccacccgcgccaccggcatccccgaccgcttctccggccgcggctccggcaccgacttcaccctcaccatctcctccctcgagcccgaggacttcgccgtctactactgccagaactacggctcccccttcctcttcaccttcggccccggcaccaaggtcgacatcaagcgcaccgtc

SEQ ID NO: 20144 - RNA, 336 nt, synthetic construct
  misc_feature 1..336: note = derived and/or modified sequence opt2 from anti-influenza_Chain
  source 1..336: mol_type = other RNA
gacatccagctcacccagtcccccctctccccccccgtcaccctcggccagcccgcctccatctcctgccgctcctcccagtccctcctctacaccgacggcttcacctacctctcctggtaccaccagcgccccggccagtccccccgccgcctcatctacaagatctccaaccgcgactccggcgtccccgaccgcttctccggctccggctccggcaccgacttcaccctcaagatctcccgcgtcgaggccgaggacgtcggcgtctactactgcatgcaggccacccactggcccctcaccttcggcgagggcaccaaggtcgagatcaag

SEQ ID NO: 20145 - RNA, 336 nt, synthetic construct
  misc_feature 1..336: note = derived and/or modified sequence opt2 from anti-influenza_Chain
  source 1..336: mol_type = other RNA
gacatcgagctcacccaggagccctccgcctccggcacccccggccagcgcgtcaccatctcctgctccggcgacacctccaacatcggctccaacaccgtctcctggttccagctcctccccggcaccgcccccaagctcctcatcttcaccgacaaccagcgcccctccggcgtccccggccgcttctccggctccaagtccggcacctccgcctccctcgccatctccggcctccagtccgaggacgagaccgactactactgcgccgcctgggacgactccctcaacggctgggtcttcggcggcggcaccaagctcaccgtcctcggccag

SEQ ID NO: 20146 - RNA, 336 nt, synthetic construct
  misc_feature 1..336: note = derived and/or modified sequence opt2 from anti-influenza_Chain
  source 1..336: mol_type = other RNA
gacatcgtcctcacccagtccccctccgcctccggctcccccggccagtccgtcaccatctcctgcaccggcacctcctccgacgtcggcggctacgactacgtctcctggtaccagcagcaccccggcaaggcccccaagctcatgatctacgaggtccgcaagcgcccctccggcgtccccgaccgcttctccggctccaagtccggcaacaccgcctccctcaccgtctccggcctccaggccgaggacgaggcctactactactgcgcctcctacgccggcacctacatccacctcttcggcggcggcaccaagctcaccgtcctcggccag

SEQ ID NO: 20147 - RNA, 336 nt, synthetic construct
  misc_feature 1..336: note = derived and/or modified sequence opt2 from anti-influenza_Chain
  source 1..336: mol_type = other RNA
caggagcagctcatggagtccggcggcggcctcgtcaagcccggcggctccctcaccctcacctgcaccgtctccggcctctccctctactccaacgagatcaactgggtccgccaggcccccggcaacggcctcgagtggatcggcgccatcgccggctccggctccgccgactacgcctcctgggccaagtcccgctccaccatcacccgcaacaccaacctcaacaccgtcaccctcaagatgacctccctcaccgccgccgacaccgccacctacttctgcgcctccttctgggacctctggggccccggcaccctcgtcaccgtctcctcc

SEQ ID NO: 20148 - RNA, 336 nt, synthetic construct
  misc_feature 1..336: note = derived and/or modified sequence opt2 from anti-influenza_Chain
  source 1..336: mol_type = other RNA
cagcagcagctcatggagtccggcggcggcctcgtcaagcccggcggctccctcaccctcacctgcaccgtctccggcctctccctctactccaacgagatcaactgggtccgccaggcccccggcaacggcctcgagtggatcggcgccatcgccggctccggctccgccgactacgcctcctgggccaagtcccgctccaccatcacccgcaacaccgacctcaacaccgtcaccctcaagatgacctccctcaccgccgccgacaccgccacctacttctgcgcctccttctgggacctctggggccccggcaccctcgtcaccgtctcctcc

SEQ ID NO: 20149 - RNA, 336 nt, synthetic construct
  misc_feature 1..336: note = derived and/or modified sequence opt2 from anti-influenza_Chain
  source 1..336: mol_type = other RNA
cagcagcagctcgtcgagtccggcggcggcctcgtcaagcccggcggctccctcaccctcacctgccgcgtctccggcctctccctcttctccaacgagatcaactgggtccgccaggcccccggcaacggcctcgagtggatcggcgccatcggcggcggcggctccgccgactacgcctcctgggccaagtcccgctccaccatcacccgcaacaccaacctcaacaccgtcaccctccgcatgacctccctcaccgccgccgacaccgccgcctacttctgcgcctccttctgggacctctggggccccggcaccctcgtcaccgtctcctcc

SEQ ID NO: 20150 - RNA, 336 nt, synthetic construct
  misc_feature 1..336: note = derived and/or modified sequence opt2 from anti-influenza_Chain
  source 1..336: mol_type = other RNA
gaggtccagctcgtcgagtccggcggcggcctcgtcaagcccggcggctccctccgcctctcctgcgccgcctccggcctctccctcttctccaacgagatcaactgggtccgccaggcccccggcaagggcctcgagtggatcggcgccatcggcggcggcggctccgccgactacgcctcctgggccaagtcccgcttcaccatctcccgcgacaacgccaagaactccctctacctccagatgaactccctccgcgccgaggacaccgccgtctacttctgcgcctccttctgggacctctggggccccggcaccctcgtcaccgtctcctcc

SEQ ID NO: 20151 - RNA, 336 nt, synthetic construct
  misc_feature 1..336: note = derived and/or modified sequence opt2 from anti-influenza_Chain
  source 1..336: mol_type = other RNA
gacatcgtcatgacccagtcccccctctccctccccgtcacccccggcgagcccgcctccatctcctgccgctcctcccagtccctcctccgctccaacggctacaactacctcgactggtacctccagaagcccggccagtccccccagctcctcatctacctcggctccaaccgcgcctccggcgtccccgaccgcttctccggctccggctccggcaccgacttcaccctcaagatctcccgcgtcgaggccgaggacgtcggcgtctactactgcatgcaggccctccagaccccctacaccttcggccagggcaccaagctcgagatcaag

SEQ ID NO: 20152 - RNA, 339 nt, synthetic construct
  misc_feature 1..339: note = derived and/or modified sequence opt2 from anti-influenza_Chain
  source 1..339: mol_type = other RNA
gacatcgtcatgacccagtcccccgacttcctccccgtctccctcggcgagcgcgccaccatcaactgcaagtcctcccagcgcgtcctctactcctccaacaacaagaactacctcgcctggtaccagctcaagcccggccagccccccaagctcatcatctactgggcctccacccgcgagtccggcgtccccgaccgcttctccggctccggctccggcaccgagttcaccctcaccatctcctccctccaggccgaggacgtcgccgtctactactgccagcagtactactcccgcccctacaccttcggccagggcaccaagctcgagatcaag

SEQ ID NO: 20153 - RNA, 339 nt, synthetic construct
  misc_feature 1..339: note = derived and/or modified sequence opt2 from anti-influenza_Chain
  source 1..339: mol_type = other RNA
gacatcgtcatgacccagtcccccgactccctcgccgtctccctcggcgagcgcgccaccatcaactgcaagtcctcccagtccgtcctctactcctccaacaacaagaactacctcgcctggtaccagcagaagcccggccagccccccaagctcctcatctactgggcctccacccgcgagtccggcgtccccgaccgcatctccggctccggctccggcgccgacttcaccctcaccatctcctccctccaggccgaggacgtcgccgtctactactgccagcagtacttcgccaccccccgcaccttcggccagggcaccaaggtcgagatcaag

SEQ ID NO: 20154 - RNA, 339 nt, synthetic construct
  misc_feature 1..339: note = derived and/or modified sequence opt2 from anti-influenza_Chain
  source 1..339: mol_type = other RNA
gacatcgtcatgacccagtcccccgactccctcgccgtctccctcggcgagcgcgccaccatcaactgcaagtcctcccagtccgtcctctactcctccaacaacaagtcccacctcgcctggtaccagcagaagcccggccagccccccaagctcctcatctactgggcctccacccgcgagtccggcgtccccgaccgcttctccggctccggctccggcaccgacttcaccctcatcatctcctccctccaggccgaggacgtcgccgtctactactgccagcagtactacttctcccccctcaccttcggcggcggcaccaaggtcgagatcaag

SEQ ID NO: 20155 - RNA, 339 nt, synthetic construct
  misc_feature 1..339: note = derived and/or modified sequence opt2 from anti-influenza_Chain
  source 1..339: mol_type = other RNA
gacatcgtcatgacccagtcccccgactccctcgccgtctccctcggcgagcgcgccaccatcaactgccgctcctcccagtccatcttccacaactccaacaacgagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctacttctgccagcagtactacaacgcccccctcaccttcggcggcggcaccaaggtcgagatcaag

SEQ ID NO: 20156 - RNA, 339 nt, synthetic construct
  misc_feature 1..339: note = derived and/or modified sequence opt2 from anti-influenza_Chain
  source 1..339: mol_type = other RNA
gagatcgtcctcacccagtcccccctctccctccccgtcacccccggcgagcccgcctccatctcctgccgctcctcccagtccctcctccactccaacggctacaactacctcgactggtacctccagaagcccggccagtccccccagctcctcatctacctcggctccaaccgcgcctccggcgtccccgaccgcttctccggctccggctccggcaccgacttcaccctcaagatctcccgcgtcgaggccgaggacgtcggcgtctactactgcatgcaggccctccagacccccctcaccttcggcggcggcaccaaggtcgagatcaagcgc

SEQ ID NO: 20157 - RNA, 339 nt, synthetic construct
  misc_feature 1..339: note = derived and/or modified sequence opt2 from anti-influenza_Chain
  source 1..339: mol_type = other RNA
gacatcgtcctcacccagcccccctccgtctccgtcgcccccggccagaccgccaccatcacctgcggcggcaactacatcggctccaagtccgtcaactggtaccagcagcgccccggccacgcccccgtcctcgtcgtctacgacgactccgaccgcccctccggcatccccgaccgcttctccggctccaactcccgctccaccgccaccaccgccaccctcaccatctcccgcgtcgaggccggcgacgaggccgactactactgccaggtctgggagacctccgaggacctctgggtcttcggcggcggcaccaagctcaccgtcctcggccag

SEQ ID NO: 20158 - RNA, 342 nt, synthetic construct
  misc_feature 1..342: note = derived and/or modified sequence opt2 from anti-influenza_Chain
  source 1..342: mol_type = other RNA
gacgtcgtcatgacccagtcccccgactccctcgccgtctccctcggcgagcgcgccaccatcaactgcaagtcctcccagtccgtcctctactcctccaacaacaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagtactactccacccccctcaccttcggcggcggcaccaaggtcgacatcaagcgc

SEQ ID NO: 20159 - RNA, 342 nt, synthetic construct
  misc_feature 1..342: note = derived and/or modified sequence opt2 from anti-influenza_Chain
  source 1..342: mol_type = other RNA
gacatccagatgacccagtcccccgactccctcgccgtctccctcggcgagaaggccaccatcaactgcaagtcctcccagtccatcctcaactcctccaacaacaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagtactactcctccccccccaccttcggccagggcaccaaggtcgagatcaagcgc

SEQ ID NO: 20160 - RNA, 342 nt, synthetic construct
  misc_feature 1..342: note = derived and/or modified sequence opt2 from anti-influenza_Chain
  source 1..342: mol_type = other RNA
gagatcgtcctcacccagtcccccgccaccctctccctctaccccggcgagcgcgccaccctctcctgccgcgcctcccagtccgtctcccgctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgctgcgaccgccagcagcgctccaactggctcaagatcaccttcggccagggcacccgcctcgagatcaagggcaccgtc

SEQ ID NO: 20161 - RNA, 342 nt, synthetic construct
  misc_feature 1..342: note = derived and/or modified sequence opt2 from anti-influenza_Chain
  source 1..342: mol_type = other RNA
gacatcgtcatgacccagtcccagaagttcgtctccacctccgtcggcgaccgcgtctccgtcacctgcaaggcctcccagaacgtcggctccaacgtcgcctggtaccagcacaagcccggccactcccccaccgccctcatctactccgcctcccaccgctactccggcgtccccgaccgcttcaccggctccgagtccggcaccgacttcaccctcaccatctccaacgtccagtccgaggacctcgccgagtacttctgccagcagtactactcctacccctacaccttcggcggcggcaccaagctcgagatcaagcgcgccgacgccgcccccacc

SEQ ID NO: 20162 - RNA, 342 nt, synthetic construct
  misc_feature 1..342: note = derived and/or modified sequence opt2 from anti-influenza_Chain
  source 1..342: mol_type = other RNA
gacatcgagatgacccagtcccccctctccctccccgtcacccccggcgagtccgcctccatctcctgccgctcctcccagtccctcctccactccaacggctacaactacctcgactggtacctccagaagcccggccagtccccccagctcctcatctacctcggctcctcccgcgcctccggcgtccccgaccgcttctccggctccggctccggcaccgacttcaccctcaagatctcccgcgtcgaggccgaggacgtcggcgtctactactgcatgcagggcctccagaccccctacaccttcggccagggcaccaagctcgagatcaagcgcacc

SEQ ID NO: 20163 - RNA, 342 nt, synthetic construct
  misc_feature 1..342: note = derived and/or modified sequence opt2 from anti-influenza_Chain
  source 1..342: mol_type = other RNA
gacatcgagatgacccagtcccccctctccctccccgtcacccccggcgagcccgcctccatctcctgccgctcctcccagtccctcctccactccaacggctacaaccacctcgcctggtacctccagaagcccggccgctccccccacctcctcatctacctcgcctccacccgcgcctccggcgtccccgaccgcttctccggctccggctccggcaccgacttcaccctcaagatctcccgcgtcgaggccgaggacgtcggcatctactactgcatgcagtccctccagacctccatcaccttcggccagggcacccgcctcgagatcaagcgcacc

SEQ ID NO: 20164 - RNA, 345 nt, synthetic construct
  misc_feature 1..345: note = derived and/or modified sequence opt2 from anti-influenza_Chain
  source 1..345: mol_type = other RNA
caggtccagctcgtccagtccggcgccgaggtcaagaagcccggctcctccgtccgcgtctcctgcaagacctccggcggcaccttctcctcctacgccgtcacctgggtccgccaggcccccggccagggcctcgagtggatgggcggcatcatcggcatgttcggcaccaccaactacgcccagaagttccagggccgcctcaccatcaccgccgacgagatgacctccaccgcctacatggagctctcctccctccgctccgaggacaccgccgtctactactgcgcccgcggctcctactactacgagaccaccctcgactactggggccgcggcaccctc

SEQ ID NO: 20165 - RNA, 345 nt, synthetic construct
  misc_feature 1..345: note = derived and/or modified sequence opt2 from anti-influenza_Chain
  source 1..345: mol_type = other RNA
gaggtccagctcgtccagtccggcgccgaggtcaagaagcccggctcctccgtcaaggtctcctgcaagacctccggcggcaccttctcctcctacgccgtcacctgggtccgccaggcccccggccagggcctcgagtggatgggcgccatcatcggcatgttcggcaccaccaactacgcccagaagttccagggccgcgtcaccatcaccgccgacgagctcacctccaccgcctacatggagctctcctccctccgctccgacgacaccgccgtctactactgcgcccgcggctcctactactacgagtcctccctcgactactggggcaagggcaccctc

SEQ ID NO: 20166 - RNA, 345 nt, synthetic construct
  misc_feature 1..345: note = derived and/or modified sequence opt2 from anti-influenza_Chain
  source 1..345: mol_type = other RNA
caggtccagctcgtccagtccggcgccgaggtcaagaagcccggctcctccgtcaaggtctcctgcaagacctccggcggcaccttctcctcctacgccgtcacctgggtccgccaggcccccggccagggcctcgagtggatgggcggcatcatcggcatgttcggcaccaccaactacgcccagaagttccagggccgcgtcaccatcaccgccgacgagctcacctccaccgcctacatggagctctcctccctccgctccgaggacaccgccgtctactactgcgcccgcggctcctactactacgagtcctccctcgactactggggccgcggcaccctc

SEQ ID NO: 20167 - RNA, 345 nt, synthetic construct
  misc_feature 1..345: note = derived and/or modified sequence opt2 from anti-influenza_Chain
  source 1..345: mol_type = other RNA
gaggtccagctcgtccagtccggcgccgaggtcaagaagcccggcgcctccgtcaaggtctcctgcaaggcctccggctacaccttcaccggctactacgtctactgggtccgccaggcccccggccagggcctcgagtggatgggctggatctccgcctacaacggcaacaccaactacgcccagaagttccagggccgcgtcaccatcaccgccgacaagtccacctccaccgcctacatggagctctcctccctccgctccgaggacaccgccgtctactactgcgcccgctcccgctccctcgacgtctggggccagggcaccaccgtcaccgtctcctcc

SEQ ID NO: 20168 - RNA, 345 nt, synthetic construct
  misc_feature 1..345: note = derived and/or modified sequence opt2 from anti-influenza_Chain
  source 1..345: mol_type = other RNA
gacatcgtcatgacccagtcccccctctccctccccgtcacccccggcgagcccgcctccatctcctgccgctcctcccagtccctcctccactccaacggccacatctacttcgactggtacctccagaagcccggccagtccccccagctcctcatctacctcgtctccaagcgcgcctccggcgtccccgaccgcttctccggctccggctccggcaccgacttcaccctcaagatctcccgcgtcgaggccgaggacgtcggcgtctactactgcatgcaggccctcgagacccccttcaccttcggccccggcaccaaggtccacatcaagcgcaccgtc

SEQ ID NO: 20169 - RNA, 345 nt, synthetic construct
  misc_feature 1..345: note = derived and/or modified sequence opt2 from anti-influenza_Chain
  source 1..345: mol_type = other RNA
cagtccgccctcacccagcccgcctccgtctccggctcccccggccagtccatcaccatctcctgcaccggcacctcctccgacgtcggcgcctacaactacgtctcctggtaccagcaccaccccggcaaggcccccaagctcatgatctacgacgtcacctaccgcccctccggcgtctccacccgcttctccggctccaagtccggcaacaccgcctccctcaccatctccggcctccaggccgaggacgaggccgactactactgctcctcccagtcccgctcctccaccctcgtcatcttcggcggcggcaccaagctcaccgtcctcggccagcccaag

SEQ ID NO: 20170 - RNA, 345 nt, synthetic construct
  misc_feature 1..345: note = derived and/or modified sequence opt2 from anti-influenza_Chain
  source 1..345: mol_type = other RNA
gacatcgtcctcacccagtcccccgtctccctcgccgtctccctcggcgagtccgccaccgtcaactgcaagtcctcccagtccgtcctctccaactccaagaacctcaactacctcgcctggtaccagcacaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagcactactccatccccctcaccttcggccccggcaccaaggtcgacatcaagcgcacc

SEQ ID NO: 20171 - RNA, 348 nt, synthetic construct
  misc_feature 1..348: note = derived and/or modified sequence opt2 from anti-influenza_Chain
  source 1..348: mol_type = other RNA
gacatcgtcctcacccagtcccccctctccctccccgtcacccccggcgagcccgcctccatctcctgccgctcctcccagtccctcctcgactccaacggctacaactacctcgactggtacctccagaagcccggccagtccccccagctcctcatctacctcgcctcctaccgcgcccccggcgtccccgaccgcttctccggctccggctccggcaccgacttcaccctcaagatctcccgcgtcgaggccgaggacgtcggcctctactactgcatgcaggccctccagaccccccccatgtacaccttcggccagggcaccaagctcgagatcaagcgcacc

SEQ ID NO: 20172 - RNA, 351 nt, synthetic construct
  misc_feature 1..351: note = derived and/or modified sequence opt2 from anti-influenza_Chain
  source 1..351: mol_type = other RNA
ctcgagtccggcggcggcctcgtccagcccggcggctccctccgcctctcctgcgccgcctccggcatcaccttctcctcctacgccatgtcctgggtccgccaggcccccggcaagggcctcgagtgggtctccaccgtcaactccggcggcggctccacctactacggcgactccgtccgcggccgcttcaccatctcccgcgacaactccaagtccaccctctacctccagctcaactccctccgcgccgaggacaccgccatctactactgcgccaaggacaagggccgccccatcttcggcctcgtcaccccctcctactacatggacgtctggggcaacggcacc

SEQ ID NO: 20173 - RNA, 351 nt, synthetic construct
  misc_feature 1..351: note = derived and/or modified sequence opt2 from anti-influenza_Chain
  source 1..351: mol_type = other RNA
caggagcagctcgtccagtccggcgccgaggtcaagaagcccggcgcctccgtcaaggtctcctgcaaggcctcccgcaagtccttcatcggctactacgtccactgggtccgccaggcccccggccagggcctcgagtggatgggctggatctcccccgactccgacgccaccaagtacgcccagaagttccagggctccgtcatcatgacccgcgacacctccgtctccaccgtctacatggagctctcccgcctcacctccgacgacaccgccctctactactgcctcctcttccgcggcggcaactccctctcctggggccagggcaccctcgtcaccgtctcctcc

SEQ ID NO: 20174 - RNA, 351 nt, synthetic construct
  misc_feature 1..351: note = derived and/or modified sequence opt2 from anti-influenza_Chain
  source 1..351: mol_type = other RNA
caggtccagctccaggagtccggccccggcctcgtcaagccctccgagaccctctccctcacctgcaccgtctccggctcctccatctccaactactactggtcctggatccgccagtcccccggcaagggcctcgagtggatcggcttcatctactacggcggcaacaccaagtacaacccctccctcaagtcccgcgtcaccatctcccaggacacctccaagtcccaggtctccctcaccatgtcctccgtcaccgccgccgagtccgccgtctacttctgcgcccgcgcctcctgctccggcggctactgcatcctcgactactggggccagggcaccctcgtcacc

SEQ ID NO: 20175 - RNA, 351 nt, synthetic construct
  misc_feature 1..351: note = derived and/or modified sequence opt2 from anti-influenza_Chain
  source 1..351: mol_type = other RNA
gaggtccagctcgtcgagtccggcggcggcctcgtccagcccggcggctccctccgcctctcctgcgccgcctccggcttcaccttctccatctacgccatgtcctgggtccgccaggcccccggcaagggcctcgagtgggtctccgccatctcctcctccggcgactccacctactacgccgactccgtcaagggccgcttcaccatctcccgcgacaacgcccgcaacaccctctacctccagatgaactccctccgcgccgaggacaccgccgtctactactgcgcccgcgcctacggctacaccttcgacccctggggccagggcaccctcgtcaccgtctcctcc

SEQ ID NO: 20176 - RNA, 354 nt, synthetic construct
  misc_feature 1..354: note = derived and/or modified sequence opt2 from anti-influenza_Chain
  source 1..354: mol_type = other RNA
caggtccagctccaggagtccggccccggcctcgtcaagccctccgagaccctctccctcacctgcaccgtctccggctactccttcgactccggctactactggggctggctccgccagccccccggcaagggcctcgagtggatcggctccatctaccactcccgcaacacctactacaacccctccctcaagtcccgcgtcaccatctccgtcgacacctccaagaaccagttctccctccagctctcctccgtcaccgccgccgacaccgccgtctactactgcgcccgcggcacctggtactcctccaacctccgctactggttcgacccctggggcaagggcaccctc

SEQ ID NO: 20177 - RNA, 354 nt, synthetic construct
  misc_feature 1..354: note = derived and/or modified sequence opt2 from anti-influenza_Chain
  source 1..354: mol_type = other RNA
cagcccgtcctcacccagcccccctccgcctccgcctccctcggcgcctccgtcaccctcacctgcaccctctcctccgcctactccaactacaaggtcgactggtaccagcagcgccccggcaagggcccccgcttcgtcatgcgcgtcggcaccggcggcatcgtcggctccaagggcgacggcatccccgaccgcttctccgtcctcggctccggcctcaaccgctacctcaccatcaagaacatccaggaggaggacgagtccgactaccactgcggcgccgaccacggctccggctccaacttcgtctccccctacgtcttcggcggcggcaccaagctcaccgtcctc

SEQ ID NO: 20178 - RNA, 354 nt, synthetic construct
  misc_feature 1..354: note = derived and/or modified sequence opt2 from anti-influenza_Chain
  source 1..354: mol_type = other RNA
caggtccagctcgtccagtccggcgccgacgtcaagaagcccggctcctccgtcaccgtctcctgcaaggcctccggcggctccttctccaactacggcatcaactgggtccgccaggcccccggccagggcctcgagtggatgggcggcatcatccccctcatcaacgcccccaactacgcccccaagttccagggccgcgtcaccatcaccgccgacatgttctccaacatcgtctccctccagctcacctccctccgcaccgacgacaccgccgtctactactgcgcccgccgcaagatgaccaccgccatcgactactggggccagggcaccctcgtcaccgtctcctcc

SEQ ID NO: 20179 - RNA, 354 nt, synthetic construct
  misc_feature 1..354: note = derived and/or modified sequence opt2 from anti-influenza_Chain
  source 1..354: mol_type = other RNA
caggtccagctcgtccagtccggcgccgaggtcaagaagcccggctcctccgtcaaggtctcctgccgcgagtccggcggcaccttcaacggctacaccatcacctgggtccgccaggcccccggccagggcctcgagtggatgggcggcatcatccccatgatgggcaccgtcaactacgcccagaagctccagggccgcgtcaccatcaccaccgactacttcaccaagaccgcctacatggacctcaacaacctccgctccgaggacaccgccatgtactactgcgtcaagatccgctacaccggccagcagctcctctggggccagggcaccctcgtcaccgtctcctcc

SEQ ID NO: 20180 - RNA, 354 nt, synthetic construct
  misc_feature 1..354: note = derived and/or modified sequence opt2 from anti-influenza_Chain
  source 1..354: mol_type = other RNA
caggtccagctcgtccagtccggcgccgaggtcaagaagcccggcgcctccgtcaaggtctcctgcaaggcctccggccacaccttcaccggctactacatccactgggtccgccaggcccccggccagggcctcgagtggatgggctggatcaaccccgactccggcgccacctcctccgcccagaacttccagggccgcgtcaccatgaccggcgacacctcctcctccaccgcctacatggagctctcccgcctctccttcgacgacaccgccgtctactactgcgcccgcgtcctcttcacctcccccttcgacttctggggcgagggcaccctcgtcaccgtctcctcc

SEQ ID NO: 20181 - RNA, 354 nt, synthetic construct
  misc_feature 1..354: note = derived and/or modified sequence opt2 from anti-influenza_Chain
  source 1..354: mol_type = other RNA
cagcccgtcctctcccagcccccctccgcctccgcctccctcggcgcctccgtcaccctcacctgcaccctctcctccggcttcgacaactaccaggtcgcctggtaccagcagcgccccggcaagggcccccgcttcgtcatgcgcgtcggcaacggcggcaacgtcgcctccaagggcgacggcatccccgaccgcttctccgtctccggctccggcctcaaccgctacctcaccatcaagaacatccaggaggacgacgagtccgactactactgcggcgccgaccacggctccggcaacaacttcgtctccccctacgtcttcggcggcggcaccaagctcaccgtcctc

SEQ ID NO: 20182 - RNA, 354 nt, synthetic construct
  misc_feature 1..354: note = derived and/or modified sequence opt2 from anti-influenza_Chain
  source 1..354: mol_type = other RNA
gaggtccagctcgtcgagtccggcgccgaggtcaagaagcccggcgcctccgtcaaggtctcctgcaaggcctccggctacaccttctcccgctactacatccactgggtccgccaggcccccggccaggagctcgagtggatgggctggatcaaccccgactccggcgacaccaactacgcccagaagttccgcggccgcgtcaccatggcccgcgacacctccatctccaccgtctacatggagctcaactccctccgctacgacgacaccgccgtctacttctgcgcccgcatcatctggtcctcctccggcatggacgtctggggccagggcaccaccgtcaccgtctcc

SEQ ID NO: 20183 - RNA, 354 nt, synthetic construct
  misc_feature 1..354: note = derived and/or modified sequence opt2 from anti-influenza_Chain
  source 1..354: mol_type = other RNA
gaggtccagctcctcgagtccggcggcggcgtcgtccagcccggccgctccctccgcctctcctgcgccgcctccggcttcaccttccgcacctacggcatgcactgggtccgccaggcccccggcaagggcctcgagtgggtcgccgtcatctcccacgacggcaacctcaagtactacggcggctccgtcaagggccgcttcaccatctcccgcgacaactccaagaacgccctctacctccagatgaactccctccgcgtcgacgacaccgccctctactactgcgcccgcggcatcggcatcaccgacgccttcgacatccgcggccagggcaccatggtcgtcgtctcc

SEQ ID NO: 20184 - RNA, 354 nt, synthetic construct
  misc_feature 1..354: note = derived and/or modified sequence opt2 from anti-influenza_Chain
  source 1..354: mol_type = other RNA
gaggtccagctcgtcgagtccggcggcggcctcgtccagcccggcggctccctccgcctctcctgcaccgcctccggcctctccgtctcctccacctacatgaactgggtccgccaggcccccggcaagggcctcgagtgggtctccgtcttctactccgagacccgcacctactacgccgactccgtcaagggccgcttcaccgtctcccgccacaactccaacaacaccctctacctccagatgaactccctccgcgtcgaggacaccgccgtctactactgcgcccgcgtccagcgcctctcctacggcatggacgtctggggccagggcaccaccgtcaccgtctcctcc

SEQ ID NO: 20185 - RNA, 354 nt, synthetic construct
  misc_feature 1..354: note = derived and/or modified sequence opt2 from anti-influenza_Chain
  source 1..354: mol_type = other RNA
gaggtccagctcgtcgagtccggcggcggcctcgtccagcccggcggctccctccgcctctcctgcaccgcctccggcctctccgtctcctccacctacatgaactgggtccgccaggcccccggcaagggcctcgagtgggtctccgtcttctactccgagacccgcacctactacgccgactccgtcaagggccgcttcaccgtctcccgccacaactccaacaacaccctctacctccagatgaactccctccgcgccgaggacaccgccgtctactactgcgcccgcgtccagcgcctctcctacggcatggacgtctggggccagggcaccaccgtcaccgtctcctcc

SEQ ID NO: 20186 - RNA, 354 nt, synthetic construct
  misc_feature 1..354: note = derived and/or modified sequence opt2 from anti-influenza_Chain
  source 1..354: mol_type = other RNA
gacatgcagctcgtcgagtccggcggcggcctcgtcccccccggcggctccctccgcctctcctgcgccgcctccggcttctccgtctccgacaactacatcaactgggtccgccaggcccccggcaagggcctcgactgggtctccgtcttctactccgccgaccgcacctcctacgccgactccgtcaagggccgcttcaccgtctcctcccacgactccaagaacaccgtctacctccagatgaactccctccgcgccgaggacaccgccgtctactactgcgcccgcgtccagaagtcctactacggcatggacgtctggggccagggcaccaccgtcaccgtctcctcc

SEQ ID NO: 20187 - RNA, 357 nt, synthetic construct
  misc_feature 1..357: note = derived and/or modified sequence opt2 from anti-influenza_Chain
  source 1..357: mol_type = other RNA
gaggtccagctcgtcgagtccggccccgtcctcgtcaagcccaccgagaccctcaccgtcacctgcaccgtctccggcttctccgtcgacaacgaccgcatgggcgtctcctggatccgccagccccccggcaaggccctcgagtggctcgcccacatcttctccaacgacgagaagtcctactccacctccctccgctcccgcctcaccatctccaaggacacctccaagcgccaggtcgtcctctccatgaccgacatggaccccgtcgacaccgccacctactactgcgcccgcgccccctccgagtacgccgccatggacgtctggggccagggcaccatggtcaccgtctcc

SEQ ID NO: 20188 - RNA, 357 nt, synthetic construct
  misc_feature 1..357: note = derived and/or modified sequence opt2 from anti-influenza_Chain
  source 1..357: mol_type = other RNA
caggtccaggtcgtccagtccggcaccgaggtcaagaagcccggctcctccgtcaaggtctcctgccagacctccggcggccgcttcatgtcctacgccatcacctgggtccgccaggcccccggccagggcctcgagtggatgggcggcatcgtccccgtcttcggcaccgccaactacgcccagaagttccagggccgcgtcaccatcaccaccgacgactccacccgcaccgcctacatggagctctcctccctccgctccgaggacaccgccgtctactactgcggcttccgctacggctccggctacggcttcgactcctggggccagggcaccctcgtcaccgtctcctcc

SEQ ID NO: 20189 - RNA, 357 nt, synthetic construct
  misc_feature 1..357: note = derived and/or modified sequence opt2 from anti-influenza_Chain
  source 1..357: mol_type = other RNA
gaggtccagctcgtcgagtccggcgccggcgtcaagaagcccggctcctccgtcaaggtctcctgcaaggcctccggcaacaccttctcctccaacgccatctcctgggtccgccaggcccccggccagggcctcgagtggatgggcggcatcctcggcatgctccgcaccaccaactacgcccagaagttccagggccgcgtcaccatcaccgccgacgagttcatgaacaccgcctacatggagctctcctccctcacctccgaggacaccgccgtctactactgcgcccgctcctccggctactaccccgactacttccacctctggggccagggcaccctcgtcaccgtctcc

SEQ ID NO: 20190 - RNA, 357 nt, synthetic construct
  misc_feature 1..357: note = derived and/or modified sequence opt2 from anti-influenza_Chain
  source 1..357: mol_type = other RNA
caggtccagctccaggagtccggccccggcctcgtcaagccctccgagaccctctccctcacctgcaccgtctccggctcctccatctccaactactactggtcctggatccgccagtcccccggcaagggcctcgagtggatcggcttcatctactacggcggcaacaccaagtacaacccctccctcaagtcccgcgtcaccatctcccaggacacctccaagtcccaggtctccctcaccatgtcctccgtcaccgccgccgagtccgccgtctacttctgcgcccgcgcctcctgctccggcggctactgcatcctcgactactggggccagggcaccctcgtcaccgtctcc

SEQ ID NO: 20191 - RNA, 357 nt, synthetic construct
  misc_feature 1..357: note = derived and/or modified sequence opt2 from anti-influenza_Chain
  source 1..357: mol_type = other RNA
gaggtccagctcgtcgagtccggcggcggcctcgtccagcccggcggctccctccgcatctcctgcgccgcctccggcttcaccgtctcctccaactacatgtcctgggtccgccaggcccccggcaagggcctcgagtgggtctccgtcatctactccggcggctccacctactacgccgactccgtcaagggccgcttctccttctcccgcgacaactccaagaacaccgtcttcctccagatgaactccctccgcgccgaggacaccgccgtctactactgcgcccgctgcctctcccgcatgcgcggctacggcctcgacgtctggggccagggcaccaccgtcaccgtctcc

SEQ ID NO: 20192 - RNA, 357 nt, synthetic construct
  misc_feature 1..357: note = derived and/or modified sequence opt2 from anti-influenza_Chain
  source 1..357: mol_type = other RNA
caggtccagctccaggagtccggccccggcctcgtcaagccctccgagaccctctccctcacctgcaccgtctccggcgcctccatctcctccgactactggtcctggatccgcctcccccccggcaagggcctcgagtggatcggctacatctacaaccgcggctccaccaagtacaccccctccctcaagtcccgcgtcaccatctccctcgacaccgccgagaaccagttctccctccgcctccgctccgtcaccgccgccgacaccgccatctactactgcgcccgccacgtcggcggccacacctacggcatcgactactggggccagggcaccctcgtcaccgtctcctcc

SEQ ID NO: 20193 - RNA, 357 nt, synthetic construct
  misc_feature 1..357: note = derived and/or modified sequence opt2 from anti-influenza_Chain
  source 1..357: mol_type = other RNA
caggtccagctccaggagtccggccccggcctcgtcaagccctccgagaccctctccctcacctgcaccgtctccggcgcctccatctcctccgactactggtcctggatccgcctcccccccggcaagggcctcgagtggatcggctacatctacaaccgcggctccaccaagtacaccccctccctcaagtcccgcgtcaccatctccctcgacaccgccgagaaccagttctccctccgcctccgctccgtcaccgccgccgacaccgccgtctactactgcgcccgccacgtcggcggccacacctacggcatcgactactggggccagggcaccctcgtcaccgtctcctcc

SEQ ID NO: 20194 - RNA, 357 nt, synthetic construct
  misc_feature 1..357: note = derived and/or modified sequence opt2 from anti-influenza_Chain
  source 1..357: mol_type = other RNA
caggtccagctccaggagtccggcccccgcctcgtcaagccctccgagtccctctccctcacctgcaccgtctccggcggctccatctccaactccttctggggctggatccgccagccccccggcgagggcctcgagtggatcggctacgtctacaactccggcaacaccaagtacaacccctccctcaagtcccgcgtcaccatctcccgcgacacctccaagtcccagctctacatgaagctccgctccgtcaccgccgccgacaccgccgtctactactgcgcccgccacgacgacgcctcccacggctactccatctcctggggccacggcaccctcgtcaccgtctcctcc

SEQ ID NO: 20195 - RNA, 357 nt, synthetic construct
  misc_feature 1..357: note = derived and/or modified sequence opt2 from anti-influenza_Chain
  source 1..357: mol_type = other RNA
gaggtccacctccagcagtccggccccgagctcgtcaagcccggcgcctccgtcaagatgtcctgcgaggcctccggctacaccttcaccgactactacgtcgcctgggtcaagcagtcccccggcgagtccttcgagtggatcggccgcgtcaacccctactccggcggcacctcctacaaccagaagttcaagggcaaggccaccctcatcgtcgacaagtcctcctccaccgcctacatggagctctcctccctcacctccgaggactccgccgtctactactgcgcccgctgggactacggcgtctacgagggctacatcgactactggggccagggctccgccctcaccgtc

SEQ ID NO: 20196 - RNA, 360 nt, synthetic construct
  misc_feature 1..360: note = derived and/or modified sequence opt2 from anti-influenza_Chain
  source 1..360: mol_type = other RNA
caggtccagctcgtccagcccggcgccgaggtcaagaagcccggctcctccgtcaaggtctcctgcaaggcctccggcggcatcttctccccctacgccatctcctgggtccgccaggcccccggccagggcctcgagtggatgggcggcatcatcgccatcttcggcaccaccaactacgcccagaagttccagggccgcgtcaccatcaccgccgacaagtccaccaccaccgcctacctcgagctcaactccctccgcttcgaggacaccgccgtctactactgcgcccgcggcggccgctactacgtcgactacttcgactactggggccagggcaccctcgtctccgtctcctcc

SEQ ID NO: 20197 - RNA, 360 nt, synthetic construct
  misc_feature 1..360: note = derived and/or modified sequence opt2 from anti-influenza_Chain
  source 1..360: mol_type = other RNA
caggtccagctccaggagtccggccccgacctcgtcaagcccggcgcctccgtcaagatgtcctgcaaggcctccggctactccttcacctactaccacatgcactgggtcaagcagacccacggcaagtccctcgagtggatcggccgcatcccctacaacggcggcaccaactactcccagcgcttcaagggcaaggccgtcttcaccgtcgacatgtcctcctccaccgcctacatggagctccgctccctcacctccgaggactccgccgtctactactgcgcccgcgacgccaactacgagggcgactggtacttcgacgtctggggccagggcaccaccgtcaccgtctcctcc

SEQ ID NO: 20198 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcgccgaggtcaaggagcccggctccgccatgaaggtctcctgcaaggcctccggcggcaccttctcctccgacgccttctgctgggtccgccaggcccccggccgcggcctcgagtggatgggcggcatcatccccgtcttccagaccgccaactacggccccaacttccagggccgcgtcaccatctccgccgacgtctacaccaccaccctctacctcgagctctccggcctcacctccgaggacaccgccgtctacttctgcgcccgctccggcgacggctacaactactacttccccctctggggccagggcaccctcgtcaccgtctcctcc

SEQ ID NO: 20199 - RNA, 360 nt, synthetic construct
  misc_feature 1..360: note = derived and/or modified sequence opt2 from anti-influenza_Chain
  source 1..360: mol_type = other RNA
cagatcaccctccgcgagtccggccccaccctcgtcaagcccacccagaccctcaccctcacctgcaccttctccggcttctccctctccaccaacggcgtcaacgtcggctggatccgccagccccccggcaaggccctcgagtggctcgccctcatctactgggacgacgacaagcgctactccccctccctcaagcgccgcctcaccatcaccaaggacacctccaagaaccaggtcgtcctcaccctcaccaacatggaccccgtcgacaccgccacctactactgcgcccaccgccccgacttctacggcgacttcgagtactggggccccggcaccctcgtcaccgtctcctcc

SEQ ID NO: 20200 - RNA, 360 nt, synthetic construct
  misc_feature 1..360: note = derived and/or modified sequence opt2 from anti-influenza_Chain
  source 1..360: mol_type = other RNA
caggtccagctcgtccagtccggctccgaggtcaagaagcccggcacctccgtcaaggtctcctgcaccgcctccggctccgtcttcaccaactacggcatctcctgggtccgccaggcccccggccagggcctcgagtggatgggcggcatcatccccctcttcggcgccgccaagtacgcccagaagttccagggccgcgtcaccatcaccgccgacgagtccaccaagaccgtctacatggagctctcccgcctcacctccaaggacaccgccatctacttctgcgccaaggccccccgcgtctacgagtactacttcgaccagtggggccagggcacccccgtcaccgtctcctcc

SEQ ID NO: 20201 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcgccgacctcaagaagcccggcgcctccgtcaaggtctcctgcaaggcctccggctacaccttcaccgactactacatccactgggtccgccaggcccccggccagggcctcgagtggatgggctggatcaaccccgagtccggcgacaccaagtacgcccagaagttccagggccgcgtcaccatgacccgcgacacctccatcaccaccgcctacatggagctcggccgcctccgctccgacgacaccgccgtctactactgcgcccgcgacgtctccaccacctggtcctggttcgccccctggggccagggcaccctcgtcaccgtctcctcc

SEQ ID NO: 20202 - RNA, 360 nt, synthetic construct
  misc_feature 1..360: note = derived and/or modified sequence opt2 from anti-influenza_Chain
  source 1..360: mol_type = other RNA
caggtccagctccaggagtccggccccggcctcgtcaagccctccgagaccctctccctcacctgctccgtctccggcggctccatcaactactactactggtcctggatccgccagccccccggcaagggcctcgagtgcatcggctacatctccgacaccggccgcacctactacaacccctccctccgctcccgcgtcaccatctccgtcgacacctccaagaaccagttctccctcaacctcacctccatgaccgccgccgacaccgccgtctactactgcgcccgcgaccccaccggctcccgccagaagaacgccttcgacatgtggggccagggcaccatggtcaccgtctcc

SEQ ID NO: 20203 - RNA, 360 nt, synthetic construct
  misc_feature 1..360: note = derived and/or modified sequence opt2 from anti-influenza_Chain
  source 1..360: mol_type = other RNA
caggtccagctccaggagtccggcccccgcgtcgtccgcccctccgagaccctctccctcacctgcaccgtctccggcggctccatctcctcctacaactggatctggatccgccagccccccggcaagggcctcgagtggatcggccacatctacgactacggccgcaccttctacaactcctccctccagtcccgccccaccatctccgtcgacgcctccaagaaccagctctccctccgcctcacctccgtcaccgcctccgacaccgccgtctactactgcgcccgccccctcggcatcctccactactacgccatggacctctggggccagggcaccaccgtcaccgtctcctcc

SEQ ID NO: 20204 - RNA, 360 nt, synthetic construct
  misc_feature 1..360: note = derived and/or modified sequence opt2 from anti-influenza_Chain
  source 1..360: mol_type = other RNA
caggtccagctccaggagtccggccccggcctcgtcaagccctccgagaccctctccctcacctgctccgtctccggcggctccatctcctccgacttctggtcctggatccgccagccccccggcaagggcctcgagtggatcggctacgtctacaaccgcggctccaccaagtactccccctccctcaagtcccgcgtcaccatctccgccgacatgtccaagaaccagttctccctcaacatgtcctccgtcaccgccgccgacaccgccgtctactactgcgccaagaacggccgctcctccacctcctggggcatcgacgtctggggcaagggcaccaccgtcaccgtctcctcc

SEQ ID NO: 20205 - RNA, 360 nt, synthetic construct
  misc_feature 1..360: note = derived and/or modified sequence opt2 from anti-influenza_Chain
  source 1..360: mol_type = other RNA
caggtccagctccaggagtccggccccggcctcgtcaagccctccgagaccctctccctcacctgcaccgtctccggcggctccatctccgcctaccactggtcctggatccgccagccccccggcaagggcctcgagtggatcggccacatcttcgactccggctccacctactacaacccctccctcaagtcccgcgtcaccatctccctcgacgcctccaagaaccagctctccctccgcctcacctccgtcaccgcctccgacaccgccatctactactgcgcccgccccctcggctcccgctactactacggcatggacgtctggggccagggcaccaccgtcaccgtctcctcc

SEQ ID NO: 20206 - RNA, 360 nt, synthetic construct
  misc_feature 1..360: note = derived and/or modified sequence opt2 from anti-influenza_Chain
  source 1..360: mol_type = other RNA
gaggtccagctcgtcgagtccggcggcggcctcgtccagcccggcggctccctccgcatctcctgcgccgcctccggcttcaccgtctcctccaactacatgtcctgggtccgccaggcccccggcaagggcctcgagtgggtctccgtcatctactccggcggctccacctactacgccgactccgtcaagggccgcttctccttctcccgcgacaactccaagaacaccgtcttcctccagatgaactccctccgcgccgaggacaccgccgtctactactgcgcccgctgcctctcccgcatgcgcggctacggcctcgacgtctggggccagggcaccaccgtcaccgtctcctcc

SEQ ID NO: 20207 - RNA, 360 nt, synthetic construct
  misc_feature 1..360: note = derived and/or modified sequence opt2 from anti-influenza_Chain
  source 1..360: mol_type = other RNA
caggtccagctccaggagtccggccccggcctcgtcaagccctccgagaccctctccctcacctgcaccgtctccggctcctccatctccaactactactggtcctggatccgccagtcccccggcaagggcctcgagtggatcggcttcatctactacggcggcaacaccaagtacaacccctccctcaagtcccgcgtcaccatctcccaggacacctccaagtcccaggtctccctcaccatgtcctccgtcaccgccgccgagtccgccgtctacttctgcgcccgcgcctcctgctccggcggctactgcatcctcgactactggggccagggcaccctcgtcaccgtctcctcc

SEQ ID NO: 20208 - RNA, 360 nt, synthetic construct
  misc_feature 1..360: note = derived and/or modified sequence opt2 from anti-influenza_Chain
  source 1..360: mol_type = other RNA
caggtccagctccagcagtccggcgccgaggtcaagaagcccggctcctccgtcaaggtctcctgcaaggtctccggcgtcatcttctccggctccgccatctcctgggtccgccaggcccccggccagggcctcgagtggatgggcggcatctcccccctcttcggcaccaccaactacgcccagaagttccagggccgcgtcaccatcaccgccgaccagtccaccaacaccacctacatggaggtcaactccctccgctacgaggacaccgccgtctacttctgcgcccgcggccccaagtactactccgagtacatggacgtctggggcaagggcaccaccgtcaccgtctcctcc

SEQ ID NO: 20209 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcatgggcatgttcggcaccaccaactacgcccagaagttccagggccgcgtcaccatcaccgccgacgagttcacctccgccgcctacatggagctccgctccctccgctccgaggacaccgccgtctactactgcgcccgctcctccggctactaccccgagtacttccaggactggggccagggcaccctcgtcaccgtctcctcc

SEQ ID NO: 20210 - RNA, 360 nt, synthetic construct
  misc_feature 1..360: note = derived and/or modified sequence opt2 from anti-influenza_Chain
  source 1..360: mol_type = other RNA
cagatgcagctcgtccagtccggcgccgaggtcaagaagcccggctcctccgtcaaggtctcctgcaaggcctccggcggcaccttctcctcctacgccatcacctgggtccgccaggcccccggccagggcctcgagtggatgggcggcatcatcggcatgttcggctccaccaactacgcccagaacttccagggccgcgtcaccatcaccgccgacgagtccacctccaccgcctacatggagctctcctccctccgctccgaggacaccgccgtctactactgcgcccgctccaccggctactaccccgcctacctccaccactggggccagggcaccctcgtcaccgtctcctcc

SEQ ID NO: 20211 - RNA, 360 nt, synthetic construct
  misc_feature 1..360: note = derived and/or modified sequence opt2 from anti-influenza_Chain
  source 1..360: mol_type = other RNA
gaggtccagctcgtcgagtccggcgccgaggtcaagaagcccggctcctccgtcaaggtctcctgcaaggcctccggcggcaccttctcctcctacggcatctcctgggtccgccaggcccccggccagggcctcgagtggatgggcgacatcatcggcatgttcggctccaccaactacgcccagaacttccagggccgcctcaccatcaccgccgacgagtccacctccaccgcctacatggagctctcctccctccgctccgaggacaccgccgtctactactgcgcccgctcctccggctactaccccgcctacctcccccactggggccagggcaccctcgtcaccgtctcctcc

SEQ ID NO: 20212 - RNA, 360 nt, synthetic construct
  misc_feature 1..360: note = derived and/or modified sequence opt2 from anti-influenza_Chain
  source 1..360: mol_type = other RNA
gaggtccagctcgtcgagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcatcggcatgttcggcaccgccaactacgcccagaagttccagggccgcgtcaccatcaccgccgacgagttcacctccaccgcctacatggagctctcctccctccgctccgaggacaccgccgtctactactgcgcccgcggcaactactactacgagtcctccctcgactactggggccagggcaccctcgtcaccgtctcctcc

SEQ ID NO: 20213 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcgccgaggtcaagaagcccggctcctccgtcaaggtctcctgcaaggcctccggcggccccttccgcaacttcgccatcaactgggtccgccaggcccccggccagggcctcgagtggatgggcggcatcatcgccgtcttcggcaccaccaagtacgcccacaagttccagggccgcgtcaccatcaccgccgacgactccaccaacaccgcctacatggagctcggctccctcaagtccgaggacaccgccgtctactactgcgcccgcggcccccactactactcctcctacatggacgtctggggcgagggcaccaccgtcaccgtctcctcc

SEQ ID NO: 20214 - RNA, 360 nt, synthetic construct
  misc_feature 1..360: note = derived and/or modified sequence opt2 from anti-influenza_Chain
  source 1..360: mol_type = other RNA
gaggtcgccctcgtcgagaccggcgccgaggtcaagaagcccggctcctccgtcaaggtcccctgcaagtcctccggctcccccttccgctccaacgccgtctcctgggtccgccaggcccccggccagggcctcgagtgggtcggcggcatcctcggcgtcttcggctccccctcctacgcccagaagttccagggccgcgtcaccatcaccgccgacgagtccaccaacaccgtccacatggagctccgcggcctccgctccgaggacaccgccgtctactactgcgcccgcggccccacctactactactcctacatggacgtctggggcaagggcaccaccgtcaccgtctcctcc

SEQ ID NO: 20215 - RNA, 360 nt, synthetic construct
  misc_feature 1..360: note = derived and/or modified sequence opt2 from anti-influenza_Chain
  source 1..360: mol_type = other RNA
cagatgcagctcgtccagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcttcggcatgttcggcaccgccaactacgcccagaagttccagggccgcgtcaccatcaccgccgacgagttcacctccgccgcctacatggagctctcctccctcggctccgaggacaccgccatgtactactgcgcccgctcctccggctactacccccagtacttccaggactggggccagggcaccctcgtcaccgtctcctcc

SEQ ID NO: 20216 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcgccgaggtcaagaagcccggctcctccgtcaaggtctcctgcaaggcctccggcgtcaccttctcctactacgccatgtcctgggtccgccaggcccccggccagggcctcgagtggatgggcggcatctcccccatgttcggcaccaccacctacgcccagaagttccagggccgcgtcaccatcaccgccgacgactccacctccaccgcctacatggaggtccgctccctccgctccgaggacaccgccgtctactactgcgcccgctcctccaactactacgactccgtctacgactactggggccagggcaccctcgtcaccgtctcctcc

SEQ ID NO: 20217 - RNA, 360 nt, synthetic construct
  misc_feature 1..360: note = derived and/or modified sequence opt2 from anti-influenza_Chain
  source 1..360: mol_type = other RNA
gaggtccagctcgtcgagaccggcgccgaggtcaagaagcccggctcctccgtcaaggtcccctgcaagtcctccggctcccccttccgctccaacgccgtctcctgggtccgccaggcccccggccagggcctcgagtgggtcggcggcatcctcggcgtcttcggctccccctcctacgcccagaagttccagggccgcgtcaccatcaccgccgacgagtccaccaacaccgtccacatggagctccgcggcctccgctccgaggacaccgccgtctactactgcgcccgcggccccacctactactactcctacatggacgtctggggcaagggcaccaccgtcaccgtctcctcc

SEQ ID NO: 20218 - RNA, 360 nt, synthetic construct
  misc_feature 1..360: note = derived and/or modified sequence opt2 from anti-influenza_Chain
  source 1..360: mol_type = other RNA
caggtccacctcgtccagtccggcgccgaggtccgcaagcccggcgcctccgtcaaggtctcctgcaaggtctccggctacaccctcaacgagctctccatccactggctccgccaggcccccggccgcggcctcgagtggatgggctccttcgaccccgaggacggcgagaccatctacgcccagaagttccagggccgcgtcaccatgaccggcgacacctccaccgacaccgcctacctcgagctcacctccctccgctccgaggacaccgccctctactactgcgcccgcggctggggcgccgtcacctcccccttcgacttctggggccagggcaccctcgtcaccgtctcctcc

SEQ ID NO: 20219 - RNA, 360 nt, synthetic construct
  misc_feature 1..360: note = derived and/or modified sequence opt2 from anti-influenza_Chain
  source 1..360: mol_type = other RNA
gaggtccagctcgtccagtccggcgccgaggtcaagaagcccggctcctccatgaaggtctcctgcaaggcctccggctccatcttctccaactacggcatctcctgggtccgccaggcccccggccagggcctcgagtggatgggcggcatcatccccatcttcggcgccgccaactacgcccagaagttccagggccgcgtcaccatcaccgccgacgagtccacctccaccgtctacatggaggtccgctccctccgctccgaggacaccgccgtctactactgcgcccgccgccagcagctctacaagggctactaccaccactggggccagggcaccctcgtcaccgtctcctcc

SEQ ID NO: 20220 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcgccggcgtcaagaagcccggctcctccatgaaggtctcctgcaaggcctccggctccatcttctccaactacggcatctcctgggtccgccaggcccccggccagggcctcgagtggatgggcggcatcatccccatcttcggcgccgccaactacgcccagaagttccagggccgcgtcaccatcaccgccgacgagtccacctccaccgtctacatggaggtccgctccctccgctccgaggacaccgccgtctactactgcgcccgccgccagcagctctacaagggctactaccaccactggggccagggcaccctcgtcaccgtctcctcc

SEQ ID NO: 20221 - RNA, 360 nt, synthetic construct
  misc_feature 1..360: note = derived and/or modified sequence opt2 from anti-influenza_Chain
  source 1..360: mol_type = other RNA
caggtccagctccaggagtccggccccggcctcgtcaagccctccgagaccctctccctcacctgcaccgtctccggcggcctcatcggcaccggctcctactactggggctggatccgccagacccccggcaagggcatggagtggatcggctccatctcctactccggctccacctactaccacccctccctcaagtcccgcgtcaccatctccgacgacacctccaagaaccagctcttcctcaagctccgctccgtcaccgccgccgacaccgcccagtactactgcgcccgctacaactggggcatccgctacttcgacttctggggccgcggcaccctcgtcaccgtctcctcc

SEQ ID NO: 20222 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcgccgaggtccgcaagcccggctcctccgtcaaggtctcctgcaaggtctccggcggcatcatccgcaagtacgccatcaactgggtccgccaggcccccggccagggcctcgagtggatgggcggcatcatcgccatcttcaacaccgccaactacgcccagaagttccagggccgcgtcaccatcaccgccgacgagtccacctccaccgtctacatggagctctcctccctccgctccgaggacaccgccctctactactgcgcccgcggcatgaactactactccgactacttcgactactggggccagggctccctcgtcaccgtctccccc

SEQ ID NO: 20223 - RNA, 360 nt, synthetic construct
  misc_feature 1..360: note = derived and/or modified sequence opt2 from anti-influenza_Chain
  source 1..360: mol_type = other RNA
caggtccagctcgtccagtccggcggcggcgtcgtccagcccggccgctccctccgcctctcctgcgccgcctccggcttcaccttccgctcccacgccatgcactgggtccgccaggcccccggcaagggccccgagtgggtcgccctcatctcctacgacgaggtcaacaagttctacgccgactccgtcaagggccgcttcaccatctcccgcgacgtctccaagaacaccgtcttcctccagatgaactccctctccgccgacgacaccgccgtctactactgcgcccgcggccactccggctcctaccgcctcttcgacttctggggccagggcaccctcgtcaccgtctcctcc

SEQ ID NO: 20224 - RNA, 360 nt, synthetic construct
  misc_feature 1..360: note = derived and/or modified sequence opt2 from anti-influenza_Chain
  source 1..360: mol_type = other RNA
caggtccagctcgtcgagtccggcggcggcctcgtccagcccggcggctccctccgcctctcctgcgccgcctccggcttcatcttcggcgacttcgccatccactgggtccgccaggcctccggcaagggcctcgagtgggtcgcccgcatccgctccggcctcaaccgcttcgagaccgcctacgccgcctccgtcgagggccgcctcaccatctcccgcgacgactccaagtccatggcctacctccagatgaacaacgtcaaggccgaggacaccgccgtctacctctgcacctacctcgtcggcgccgtcggcttccagcactggggccagggcaccctcgtcaccgtctcctcc

SEQ ID NO: 20225 - RNA, 360 nt, synthetic construct
  misc_feature 1..360: note = derived and/or modified sequence opt2 from anti-influenza_Chain
  source 1..360: mol_type = other RNA
caggtccagctcgtcgagtccggcggcggcgtcgtccagcccggccgctccctccgcctctcctgcgccgcctccggcttcaccttctcctcctacggcatctactgggtccgccaggcccccggcaagggcctcgagtgggtcgccttcatctcctacgacgagatcaacaagttctacgccgactccgtcaagggccgcttcaccatctcccgcgacaactccaagaacaccgtcttcctccagatgaactccctccgcgacgaggacaccgccgtctactactgcgccaagcccctccgcggctcctaccgctacttcgacctctggggccgcggcaccgtcgtcaccgtctcctcc

SEQ ID NO: 20226 - RNA, 363 nt, synthetic construct
  misc_feature 1..363: note = derived and/or modified sequence opt2 from anti-influenza_Chain
  source 1..363: mol_type = other RNA
caggtccagctccaggagtccggccccgacctcgtcaagcccggcgcctccgtcatgatctcctgcaaggcctccggctactccttcacctactactacatgcactgggtcaagcagtcccacggcaagaccctcgagtggatcggccgcatctacccctacaacggcgacaccaactacaaccgccgcttcaaggacaaggccatcctcaccgtcgacgagtcctcctccaccgcctacatggagctccgctccctcacctccgaggactccgccgtctacttctgcgcccgcgacgccaactacgagggcgactggtacttcgacgtctggggccagggcaccaccgtcaccgtctcctcc

SEQ ID NO: 20227 - RNA, 363 nt, synthetic construct
  misc_feature 1..363: note = derived and/or modified sequence opt2 from anti-influenza_Chain
  source 1..363: mol_type = other RNA
caggtccagctcgtccagtccggcggcggcgtcgtccagcccggccgctccctccgcctctcctgcgccgcctccggcttcaccttctcctcctacgccatgcactgggtccgccaggcccccggcaagggcctcgagtgggtcgccatcatctcctacgacggcaacgaccagtactacaccgactccgtcaagggccgcttcaccatctcccgcgactcctccaaggtctacctccagatgcaccgcctccgccccgaggacaccgccgtctactactgcgccaaggagttcgagacctccggctacttccacggctccttcgactactggggccagggcatcctcgtcaccgtctcctcc

SEQ ID NO: 20228 - RNA, 363 nt, synthetic construct
  misc_feature 1..363: note = derived and/or modified sequence opt2 from anti-influenza_Chain
  source 1..363: mol_type = other RNA
caggtccaggtcgtccagtccggcgccgaggtcaagaagcccggctcctccgtccgcgtctcctgccaggcctccggcggcaccttcatgaactacgccatcatctgggtccgccgcgcccccggccagggcctcgagtggatgggcggcatcatccccgtcttccccacccccaactacgcccagatgttccagggccgcgtcaccatctccaccgacgagtcccgctccacctccttcctcgagctcaccaacctccgctacgaggacaccgccgtctactactgcgcccgccgcatctaccacggcggcaactccggcttcgacttctggggccagggcaccctcgtcaccgtctcctcc

SEQ ID NO: 20229 - RNA, 363 nt, synthetic construct
  misc_feature 1..363: note = derived and/or modified sequence opt2 from anti-influenza_Chain
  source 1..363: mol_type = other RNA
caggtccagctccaggagtccggccccggcctcctcaagccctccgacaccctcgccctcacctgcaccgtctccggcggctccatcacctccgactactggtcctggatccgccagccccccggccgcggcctcgactggatcggcttcttctacaacggcggctccaccaagtacaacccctccctcaagtcccgcgtcaccatctccgccgacacctccaagaaccagctctccctcaagctcacctccgtcaccgccgccgacaccggcgtctactactgcgcccgccacgacgccaagttctccggctcctactacgtcgcctcctggggccagggcacccgcgtcaccgtctcctcc

SEQ ID NO: 20230 - RNA, 363 nt, synthetic construct
  misc_feature 1..363: note = derived and/or modified sequence opt2 from anti-influenza_Chain
  source 1..363: mol_type = other RNA
caggtccagctccaggagtccggccccggcctcctcaagccctccgacaccctcgccctcacctgcaccgtctccggcggctccatcacctccgactactggtcctggatccgccagccccccggccgcggcctcgactggatcggcttcttctacaacggcggctccaccaagtacaacccctccctcaagtcccgcgtcaccatctccgccgacacctccaagaaccagctctccctcaagctcacctccgtcaccgccgccgacaccggcgtctactactgcgcccgccacgacgtcaagttctccggctcctactacgtcgcctcctggggccagggcacccgcgtcaccgtctcctcc

SEQ ID NO: 20231 - RNA, 363 nt, synthetic construct
  misc_feature 1..363: note = derived and/or modified sequence opt2 from anti-influenza_Chain
  source 1..363: mol_type = other RNA
caggtccagctccaggagtccggccccggcctcgtcaagccctccgagaccctctccgtcacctgcaaggtctccggcgactccatctcctcctactcctggtcctggatccgccagccccccggcaagggcctcgagtgggtcggctacctctactactccggctccaccaagtacaacccctccctcaagtcccgcaccaccatctccgtcgacacctccaccaaccagctctccctcaagctctccttcgtcaccgccgccgacaccgccgtctacttctgcgcccgcaccggctccgagtccaccaccggctacggcatggacgtctggggccagggcaccaccgtcaccgtctcctcc

SEQ ID NO: 20232 - RNA, 363 nt, synthetic construct
  misc_feature 1..363: note = derived and/or modified sequence opt2 from anti-influenza_Chain
  source 1..363: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctcc

SEQ ID NO: 20233 - RNA, 363 nt, synthetic construct
  misc_feature 1..363: note = derived and/or modified sequence opt2 from anti-influenza_Chain
  source 1..363: mol_type = other RNA
caggtccagctcgtccagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctcc

SEQ ID NO: 20234 - RNA, 363 nt, synthetic construct
  misc_feature 1..363: note = derived and/or modified sequence opt2 from anti-influenza_Chain
  source 1..363: mol_type = other RNA
gaggtccagctcgtcgagaccggcgccgaggtcaagaagcccggcgcctccgtcaaggtctcctgcaaggcctccggctacaccttcacctcctactacatgcactgggtccgccaggcccccggccagggcctcgagtggatgggctggatcaaccccaactccggcggcaccaactacgcccagaagttccagggccgcgtcaccatgacccgcgacacctccatctccaccgcctacatggagctctcccgcctccgctccgacgacaccgccgtctactactgcgcccgcgagggcaagtggggcccccaggccgccttcgacatctggggccagggcaccatggtcaccgtctcctcc

SEQ ID NO: 20235 - RNA, 363 nt, synthetic construct
  misc_feature 1..363: note = derived and/or modified sequence opt2 from anti-influenza_Chain
  source 1..363: mol_type = other RNA
gaggtccagctcgtcgagtccggcgccgaggtcaagaagcccggctcctccgtcaaggtctcctgcaaggcctccggcggcaccttctccttctactccatgtcctgggtccgccaggcccccggccagggcctcgagtggatgggcggcatcatccccatgttcggcaccaccaactacgcccagaagttccagggccgcgtcaccatcaccgccgtcgagtccacctccaccgcctacatggaggtctcctccctccgctccgaggacaccgccgtctactactgcgcccgcggcgacaagggcatctactactactacatggacgtctggggcaagggcaccaccgtcaccgtctcctcc

SEQ ID NO: 20236 - RNA, 363 nt, synthetic construct
  misc_feature 1..363: note = derived and/or modified sequence opt2 from anti-influenza_Chain
  source 1..363: mol_type = other RNA
gaggtccagctcgtcgagaccggcgccgaggtcaagaagcccggctcctccgtcaaggtctcctgcaaggcctccggcggcaccttccgcacccacgccatctcctgggtccgccaggcccccggccagggcctcgagtggatgggcggcatcatcgccatcttcggcaccgccaactacgcccagaagttccagggccgcatcaccatcaccgccgacgagtccacctccaccgcctacatggagctctcctccctccgctccgaggacaccgccgtctacttctgcgcccgcggctccggctaccacatctccacccccttcgacaactggggccagggcaccctcgtcaccgtctcctcc

SEQ ID NO: 20237 - RNA, 363 nt, synthetic construct
  misc_feature 1..363: note = derived and/or modified sequence opt2 from anti-influenza_Chain
  source 1..363: mol_type = other RNA
gaggtccagctcgtccagtccggcgccgaggtcaagaagcccggctcctccgtcaaggtctcctgcaaggcctccggcggcatcttccgctccaactccatctcctgggtccgccaggcccccggccagggcctcgagtggatgggcggcatcttcgccctcttcggcaccaccgactacgcccagaagttccagggccgcgtcaccatcaccgccgacgagtcctccaccaccgtctacctcgagctctcctccctcacctccgaggacaccgccgtctactactgcgcccgcggctccggctacaccacccgcaactacttcgactactggggccagggcaccctcgtcaccgtctcctcc

SEQ ID NO: 20238 - RNA, 363 nt, synthetic construct
  misc_feature 1..363: note = derived and/or modified sequence opt2 from anti-influenza_Chain
  source 1..363: mol_type = other RNA
gaggtccagctcgtcgagtccggcgccgaggtcaagaagcccggctcctccgtcaaggtctcctgcaaggcctccggcggcatcttcaactcctacgccatctcctgggtccgccaggcccccggccagggcctcgagtggatgggcggcatcatcgccatcttccacacccccaagtacgcccagaagttccagggccgcgtcaccatcaccgccgacgagtccaccaacaccgcctacatggagctccgctccctcaagtccgaggacaccgccctctactactgcgcccgcggctccacctacgacttctcctccggcctcgactactggggccagggcaccctcgtcaccgtctcctcc

SEQ ID NO: 20239 - RNA, 363 nt, synthetic construct
  misc_feature 1..363: note = derived and/or modified sequence opt2 from anti-influenza_Chain
  source 1..363: mol_type = other RNA
caggtccagctcgtccagtccggcgccgaggtcaagaagcccggctcctccgtcaaggtctcctgcaagtcctccggcggcaacttcaacaactacgccgtctcctgggtccgccaggcccccggccagggcctcgagtggatgggcggcatctcccccatcttcggctccaccaaccacgcccagaagttccagggccgcgtcaccatctccgccgacatcttcaccaacaccgcctacatggagctctcctccctccgctccgacgacaccgccatctactactgcgcccgcggccgcggctactacttctaccacgccatggacgtctggggccagggctccaccgtcaccgtctcctcc

SEQ ID NO: 20240 - RNA, 363 nt, synthetic construct
  misc_feature 1..363: note = derived and/or modified sequence opt2 from anti-influenza_Chain
  source 1..363: mol_type = other RNA
caggtccagctcgtccagtccggcgccgaggtcaagaagcccggctcctccgtcaaggtctcctgcaaggcctccggcggcaccttcaacaactacgccatcaactgggtccgccaggcccccggccagggcctcgagtggatgggcggcatctcccccatcttcggctccgtcaactacgcccagaagctccagggccgcgtcaccatcaccgccgacgtcttcacctccaccgcctacatggagctctcctccctccgctccgaggacaccgccgtctactactgcgccaagggctccggctactactactactacggcctcgacgtctggggcctcggcaccaccgtcaccgtctcctcc

SEQ ID NO: 20241 - RNA, 363 nt, synthetic construct
  misc_feature 1..363: note = derived and/or modified sequence opt2 from anti-influenza_Chain
  source 1..363: mol_type = other RNA
caggtccagctcgtcgagtccggcggcggcgtcgtccagcccggccgctccctccgcctctcctgcgccgcctccggcttcaccttcaccaactacgccatgcactgggtccgccaggcccccggcaagggcctcgagtgggtcgccgtcatctccttcgacgaggacaacaagtcctacgccgactacgtcaagggccgcttcaccatctcccgcgacaactccaacaaccgcctctacctccagatgaactccctccgcgccgaggacaccgccgtctactactgcgcccgcggccccgagggcgtctggggccgctccatcgactcctggggccagggcaccctcgtcaccgtctcctcc

SEQ ID NO: 20242 - RNA, 363 nt, synthetic construct
  misc_feature 1..363: note = derived and/or modified sequence opt2 from anti-influenza_Chain
  source 1..363: mol_type = other RNA
caggtccagctcgtccagtccggcggcgacctcgtccagcccggcggctccctccgcctctcctgcgccgcctccggcttcaccttctcccgctactccatgaactgggtccgccaggcccccggcatgggcctcgagtgggtcgcctacatctccgacacctcccgcaccatctactacgccgactccgtcaagggccgcttcaccatctcccgcgacaacgccaagaactccctctacctccagatgaagtccctccgcgacgaggacaccgccgtctactactgcgcccgcgaccccgacacccccttcgtccgcgccttcgactcctggggccagggcaccctcgtcaccgtctcctcc

SEQ ID NO: 20243 - RNA, 363 nt, synthetic construct
  misc_feature 1..363: note = derived and/or modified sequence opt2 from anti-influenza_Chain
  source 1..363: mol_type = other RNA
caggtccagctcgtcgagtccggcggcggcctcgtccagcccggcggctccctccgcctctcctgcgtcgcctccggcttcaccttctcccgcttctccatgaactgggtccgccaggcccccggcatgggcctcgagtgggtctcctacatctccgacaccggccgcaccatctactacgccgactccgtcaagggccgcttcaccatctcccgcgacaacgacaagaacaccctctacctccagatgaagtccctccgcgacgaggactccgccttctactactgcgcccgcgaccccgacacccccttcgtccgcgccttcgactcctggggccagggcgtcctcgtcaccgtctcctcc

SEQ ID NO: 20244 - RNA, 363 nt, synthetic construct
  misc_feature 1..363: note = derived and/or modified sequence opt2 from anti-influenza_Chain
  source 1..363: mol_type = other RNA
caggtccagctccaggagtccggccccgacctcgtcaagcccggcgcctccgtcaagatgtcctgcaaggcctccggctactccttcacctactaccacatgcactgggtcaagcagacccacggcaagtccctcgagtggatcggccgcatctacccctacaacggcggcaccaactactcccagcgcttcaagggcaaggccgtcttcaccgtcgacatgtcctcctccaccgcctacatggagctccgctccctcacctccgaggactccgccgtctactactgcgcccgcgacgccaactacgagggcgactggtacttcgacgtctggggccagggcaccaccgtcaccgtctcctcc

SEQ ID NO: 20245 - RNA, 366 nt, synthetic construct
  misc_feature 1..366: note = derived and/or modified sequence opt2 from anti-influenza_Chain
  source 1..366: mol_type = other RNA
cagggccagctcgtccagtccggcgccgaggtcaagaagtccggctcctccgtcaaggtctcctgcaagacctccggcggcaccttcaactcccacgccatctcctgggtccgccaggcccccggccagggcctcgagtggatcggcggcatcatccccatgttcggcaccaccaactacgcccagaagctcaagggccgcatcgccatcaccgccgaccagctccccaccaccgcctacctcgagctctcctccctccgctccgaggacaccgccgtctactactgcgcccgcggccagcgctactactacgaccgcgacggcatggacgtctggggccagggcaccatggtcaccgtctcctcc

SEQ ID NO: 20246 - RNA, 366 nt, synthetic construct
  misc_feature 1..366: note = derived and/or modified sequence opt2 from anti-influenza_Chain
  source 1..366: mol_type = other RNA
caggtccacctcgtccagtccggcgccgaggtcaagaagcccggctcctccgtccgcctctcctgctccgcctccggcggccccttctccggcttcgccatctcctggctccgccaggcccccggccagggcctcgagtggctcggcggcatctccgccgtcttcggcaccgccacctacgcccagaagttccagggccgcgtcaccatcaccgccgaccagttcacctccacctcccacatggacctctcccgcctcacctacgacgacaccgccgtctactactgcgcccgctccggcggctacctcccccagaacaactggatcgacccctggggccagggcaccctcgtcatcgtctcctcc

SEQ ID NO: 20247 - RNA, 366 nt, synthetic construct
  misc_feature 1..366: note = derived and/or modified sequence opt2 from anti-influenza_Chain
  source 1..366: mol_type = other RNA
caggtccagctcgtccagtccggcgccgaggtcaagaaggccggctcctccgtcaaggtctcctgccagtcctccggcgtcaccttctccatgtacgccgtctcctgggtccgccaggcccccggccagggcctcgagtggatgggcggcatcatccccctcttcggcaccaccacctacgcccagaagttcgagggccgcctcaccatcaccgccgacacctccaccaacatggcctacctcgagctccgctccctccgctccgaggacaccgccgtctacttctgcgcccgcgccggcaccaccgtcacccgcttcaactggttcgacccctggggccagggcaccctcgtcaccgtctcctcc

SEQ ID NO: 20248 - RNA, 366 nt, synthetic construct
  misc_feature 1..366: note = derived and/or modified sequence opt2 from anti-influenza_Chain
  source 1..366: mol_type = other RNA
caggtccagctcgtccagtccggcgccgaggtcaagaagcccggctcctccctcaaggtctcctgcaaggcctccggcgtcaccttctccatgtacaccatctcctgggtccgccaggcccccggccagggcctcgagtggatgggcggcatcatccccctcttcggcaccgccaactacgagcagaagttccagggccgcgtcaccatcaccgccgacacctccaccaacaccgcctacatggagctctcctccctccgctccgaggacaccgccgtctactactgcgcccgcgccggcaccaccctcacccgcttcaactggttcgacccctggggccagggcaccctcgtcaccgtctcctcc

SEQ ID NO: 20249 - RNA, 366 nt, synthetic construct
  misc_feature 1..366: note = derived and/or modified sequence opt2 from anti-influenza_Chain
  source 1..366: mol_type = other RNA
atggccgacaacatgaccaccacccagatcgagtggcgcatgaagaagatggccatcggctcctccacccactcctcctccgtcctcatgaaggacatccagtcccagttcgagcagctcaagctccgctgggagtcctaccccaacctcgtcaagtccaccgactaccaccagaagcgcgagaccatccgcctcgccaccgaggagctctacctcctctccaagcgcatcgacgactccatcctcttccacaagaccgtcatcgccaactcctccatcatcgccgacatgatcgtctccctctccctcctcgagaccctctacgagatgaaggacgtcgtcgaggtctactcccgccagtgcctc

SEQ ID NO: 20250 - RNA, 366 nt, synthetic construct
  misc_feature 1..366: note = derived and/or modified sequence opt2 from anti-influenza_Chain
  source 1..366: mol_type = other RNA
gaggtccagctcgtccagtccggcggcggcctcgtccagcccggcggctccctccgcctcgcctgcgtcgtctccggcttcaccgtcacctccaactacatcacctgggtccgccaggcccccggcaagggcctcgagtgggtctccgtcatctactcccacggccgcgcctactactccgcctccgtcaacggccgcttcaccatctcccgccacacctccaagaacaccgtctacctcgagatgaactccctccgccccgaggacaccgccgtctactactgcgccggcggcggcctcgtcggcggctacgacgagtacttcttcgactactggggccagggcaccctcgccaccgtctcctcc

SEQ ID NO: 20251 - RNA, 366 nt, synthetic construct
  misc_feature 1..366: note = derived and/or modified sequence opt2 from anti-influenza_Chain
  source 1..366: mol_type = other RNA
caggtccagctcgtccagtccggcgccgaggtcaagaagcccggcgcctccgtcaaggtctcctgcaaggcctccggctacaccttcaccggctactacatgcactgggtccgccaggcccccggccagggcctcgagtggatgggctggatcaaccccaactccggcgacaccaactacgcccagaagttccagggccgcgtcaccatgacccgcgacacctccatcaccaccgcctacatggagctctcctccctccgctccgacgacaccgccgtctactactgcgcccgcgactccccctactcctcctcctggtccttcttcgactactggggccagggccccctcgtcaccgtctcctcc

SEQ ID NO: 20252 - RNA, 366 nt, synthetic construct
  misc_feature 1..366: note = derived and/or modified sequence opt2 from anti-influenza_Chain
  source 1..366: mol_type = other RNA
gaggtccagctcgtcgagtccggcggcggcctcgtccagcccggcggctccctccgcctctcctgcgccgcctccggcttcatcttccgcaactactggatgtcctgggtccgccaggcccccggcaagggcctcgagtgggtcgccaacatcaagcaggacggccgcgagaagtactacgtcgactccctccgcggccgcgtcaacatctcccgcgacaacgccgagaactccctctacctccacatgaactccctccgcgtcgaggacaccgccgtctacttctgcgcccgcgcccgcatggtcgtcgtcaccggcgacggcttcgacgtctggggccacggcaccatggtcaccgtctcctcc

SEQ ID NO: 20253 - RNA, 366 nt, synthetic construct
  misc_feature 1..366: note = derived and/or modified sequence opt2 from anti-influenza_Chain
  source 1..366: mol_type = other RNA
gaggtccagctcctcgagtccggcggcggcctcgtccagcccggcggctccctccgcctctcctgcgccgcctccggcttcgccttctcctcctacggcatgtcctgggtccgccaggcccccggcaagggcctcgagtgggtctccgccttctccggctccggcacctccacctactacgccgactccgtcaagggccgcttcaccatctcccgcgacaagtccaagaacaccctctacctccagatgaactccctccgcgccgaggacaccgccatctactactgcgccaagccccccggcccctacatcgtcgtcgccggcctcttcgagaactggggccgcggcaccctcgtcaccgtctcc

SEQ ID NO: 20254 - RNA, 366 nt, synthetic construct
  misc_feature 1..366: note = derived and/or modified sequence opt2 from anti-influenza_Chain
  source 1..366: mol_type = other RNA
gaggtccagctcgtcgagtccggcggcggcgtcgtccagcccggccgctccctccgcctctcctgcgccgcctccggcttctccttctccaactacgccatgcactgggtccgccaggcccccggcaagggcctcgagtgggtcgccctcatctccttcgacggctccgacaagtactacgccgactccgtcaagggccgcttcaccatgtcccgcgacaactccaagaacaccctctacctccagatgaactccctccgcgccgaggacaccgccgtctactactgcgcccgcgacgagccctactgcggcggcgactgcttcgccttcgacgtctggggccagggcaccatggtcaccgtctcc

SEQ ID NO: 20255 - RNA, 366 nt, synthetic construct
  misc_feature 1..366: note = derived and/or modified sequence opt2 from anti-influenza_Chain
  source 1..366: mol_type = other RNA
caggtccagctccagcagtccggccccggcctcgtcaagccctcccagaccctctccctcacctgcaccgtctccggcggccccgtctccggcggcggctactcctggaactggatccgccagcgccccggccagggcctcgagtgggtcggcttcatgttccactccggctccccccgctacaaccccaccctcaagtcccgcatcaccatctccgtcgacacctccaagaacctcgtctccctcaagctctcctccgtcaccgccgccgacaccgccgtctacttctgcgcccgcgtcggccagatggacaagtactacgccatggacgtctggggccagggcaccaccgtcaccgtctcctcc

SEQ ID NO: 20256 - RNA, 366 nt, synthetic construct
  misc_feature 1..366: note = derived and/or modified sequence opt2 from anti-influenza_Chain
  source 1..366: mol_type = other RNA
caggtccagctcgtccagtccggcggcggcctcgtcaagcccggcggctccctccgcctctcctgcgccgcctccggcttcaccttctcctcctactccatgaactgggtccgccaggcccccggcaagggcctcgagtgggtctcctccatctcctcctcctcctcctacatctactacgtcgactccgtcaagggccgcttcaccatctcccgcgacaacgccaagaactccctctacctccagatgaactccctccgcgccgaggacaccgccgtctactactgcgcccgcggcggcggctcctacggcgcctacgagggcttcgactactggggccagggcaccctcgtcaccgtctcctcc

SEQ ID NO: 20257 - RNA, 366 nt, synthetic construct
  misc_feature 1..366: note = derived and/or modified sequence opt2 from anti-influenza_Chain
  source 1..366: mol_type = other RNA
caggtccagctcgtccagtccggcggcggcgtcgtccagcccggccgctccctccgcctctcctgcgccgcctccggcttcaacttctcctcctacggcatgcactgggtccgccaggcccccggcaagggcctcgagtggctctccgtcatctggtccggcggctccaacaagtactacgccgactccgtcaagggccgcttcaccatctcccgcgacgactccaagaacaccgtctacctccagatgaactccctccgcgacgaggacaccgccgtctactactgcgcccgcgcccacaccgccctcacccgcttccgctggctcgacccctggggccagggcatcctcgtcaccgtctcctcc

SEQ ID NO: 20258 - RNA, 366 nt, synthetic construct
  misc_feature 1..366: note = derived and/or modified sequence opt2 from anti-influenza_Chain
  source 1..366: mol_type = other RNA
caggtccagctcgtccagtccggcggcggcgtcgtccagcgcggccgctccctccgcctctcctgcgccgcctccggcttcaccttccgcacctacggcatgcactgggtccgccaggcccccggcaagggcctcgagtgcgtcgccctcatctcctacgacggcaccaacaagtactacgccgactccgtcaagggccgcttcaccatctcccgcgacaactccaaggacaccctctacctccagatgaactccctccgcgccgaggacaccggcgtctactactgcgcctccctcgactacgacttctcctactactaccaccgcgacgtctggggccccggcaccaccgtcaccgtctcctcc

SEQ ID NO: 20259 - RNA, 366 nt, synthetic construct
  misc_feature 1..366: note = derived and/or modified sequence opt2 from anti-influenza_Chain
  source 1..366: mol_type = other RNA
caggtccagctcgtcgagtccggcggcggcctcgtccagcccggcggctccctccgcctctcctgcgccgcctccggcttcaccttctccgactactggatggtctgggtccgccaggcccccggcaagggcctcgtctgggtctcccgcatctcctccgacggctccaccacctcctacgccgactccgtcaagggccccttcaccatctcccgcgacaacgccaagaacaccctctacctccagatgaactccctccgcgccgaggacaccgccgtctactactgcgcccgcgtcgccaccccctactactacgagtccggcttcgactactggggccagggcgccctcgtcaccgtctcctcc

SEQ ID NO: 20260 - RNA, 369 nt, synthetic construct
  misc_feature 1..369: note = derived and/or modified sequence opt2 from anti-influenza_Chain
  source 1..369: mol_type = other RNA
cagttccagctcgtccagtccggccccgaggtcaagaagcccggcacctccgtcaaggtctcctgcaaggcctccggctacacctccaccacctacggcatctcctgggtccgccaggtccccggccagggcctcgagtggatgggctggatcaacccctacaacggcaacccccactacggccagaagttccagggccgcgtcaccctcacccgcgacacctccaccaacaccgcctacctcgagatcctctccctccgctccgacgacaccgccgtctactactgcgcccgcgacggctggggccagcagctcgtcccctactacttcgactactggggccagggcaccctcgtcaccgtctcctcc

SEQ ID NO: 20261 - RNA, 369 nt, synthetic construct
  misc_feature 1..369: note = derived and/or modified sequence opt2 from anti-influenza_Chain
  source 1..369: mol_type = other RNA
caggtccagctcgcccagtccggcgccgaggtcaagcgccccggctcctccgtcaaggtctcctgcaccgcctccggcggcatcttccgcaagaacgccatctcctgggtccgccaggcccccggccagggcctcgagtggatgggcggcatcatcgccgtcttcaacaccgccaactacgcccagaagttccagggccgcgtcaagatcaccgccgacgagtccggcaacaccgcctacatggagctctcctccctccgctccgacgacaccgccgtctactactgcgcctcccaccccaagtacttctacggctccggctcctaccccgacttctggggccagggcaccctcgtcaccgtctcctcc

SEQ ID NO: 20262 - RNA, 369 nt, synthetic construct
  misc_feature 1..369: note = derived and/or modified sequence opt2 from anti-influenza_Chain
  source 1..369: mol_type = other RNA
caggtccagctccaggagtccggccccggcctcgtcaagccctccgagaccctctccctcacctgcaccgtctcccgcggctccatcggccactacttctggtcctggatccgccagccccccggcaagggcctcgagtggatcggctacatctcctactccggctccaccaagtacaacccctccctccgctcccgcgtcaccatctccgtcgacacctccaagaaccagttctccctcaacctcaactccgtcaccgccaccgacaccgccctctactactgcgcccgcgaggactacgacatcctcaccggcgccggccccggcatggaggtctggggccagggcaccaccgtcaccgtctcctcc

SEQ ID NO: 20263 - RNA, 369 nt, synthetic construct
  misc_feature 1..369: note = derived and/or modified sequence opt2 from anti-influenza_Chain
  source 1..369: mol_type = other RNA
caggtccagctccaggagtccggccccggcctcgtcaagccctccgagaccctctccctcacctgcaccgtctccggcgcctccatcaactcccactactggtcctggatccgccagccccccggcaagggcctcgagtggatcggctacgtctactactccggctccaccacctacaacccctccctcaagtcccgcgtcaccctctccgtcgacacctccaagaaccagttctccctcaacctctcctccgtcaccgccgccgacaccgccttctactactgcgcccgccacccctacgacgtcctcaccggctccggcgactggttcgacccctggggccagggcaccctcgtcaccgtctcctcc

SEQ ID NO: 20264 - RNA, 369 nt, synthetic construct
  misc_feature 1..369: note = derived and/or modified sequence opt2 from anti-influenza_Chain
  source 1..369: mol_type = other RNA
caggtccagctcgtccagtccggcgccgaggtcaagcgccccggctcctccgtcaaggtctcctgcaccgcctccggcggcatcttccgcaagaacgccatctcctgggtccgccaggcccccggccagggcctcgagtggatgggcggcatcatcgccgtcttcaacaccgccaactacgcccagaagttccagaaccgcgtcaagatcaccgccgacgagtccggcaacaccgcctacatggagctctcctccctcacctccgacgacaccgccgtctactactgcgcctcccaccccaagtacttctacggctccggctcctaccccgacttctggggccagggcaccctcgtcaccgtctcctcc

SEQ ID NO: 20265 - RNA, 369 nt, synthetic construct
  misc_feature 1..369: note = derived and/or modified sequence opt2 from anti-influenza_Chain
  source 1..369: mol_type = other RNA
gaggtccagctcgtcgagtccggcgccgaggtcaagaagcccggctcctccgtcaaggtctcctgcaaggcctccggcggcaccttccgctcctacgccgtctcctgggtccgccaggcccccggccagggcctcgagtggatgggcggcatcatcgccatcttcggcaccaccaactacgcccagaagttccaggaccgcgtcaccatcaccgccgacgacctcccctccaccgcctacatggagctcacctccctccgctccgaggacaccgccgtctacttctgcgtccgcggccgcggctactacctcggcggcgactacggctccctcgactcctggggccagggcaccctcgtcaccgtctcc

SEQ ID NO: 20266 - RNA, 369 nt, synthetic construct
  misc_feature 1..369: note = derived and/or modified sequence opt2 from anti-influenza_Chain
  source 1..369: mol_type = other RNA
gaggtccagctcgtcgagtccggcggcggcctcgtccagcccggccgctccctccgcctctcctgcgtcggctccggcttcaacttcgacggctacgccatgcagtgggtccgccaggtccccggcaagggcctcgagtgggtctccggcatctcctggcactccgactccaccggctacgccgactccgtccgcggccgcttcaccatctcccgcgacaacgccaagaactccctctacctccagatggactccctccgccccgaggacaccgccttctactactgcggcaagtccatcggccacgtcggcggctcctaccgccaccccatcgactactggggccagggcaccctcgtcaccgtctcc

SEQ ID NO: 20267 - RNA, 369 nt, synthetic construct
  misc_feature 1..369: note = derived and/or modified sequence opt2 from anti-influenza_Chain
  source 1..369: mol_type = other RNA
caggtccagctccaggcctccggccccggcctcgtcaagccctccgagaccctctccctcacctgcaccgtctccggcgactccatcacctccggcgcctactactggacctggatccgccagcaccccggcaagggcctcgagtggatcggctacatctactactccggcaacacctactacaacccctccctcaagtcccgcgtcaccatctccctcgacacctccaagaaccagttctccctcaaggtcaactccgtcaccgccgccgacaccgccgtctactactgcgcccgcgccgcctccacctccgtcctcggctacggcatggacgtctggggccagggcaccaccgtcaccgtctcctcc

SEQ ID NO: 20268 - RNA, 369 nt, synthetic construct
  misc_feature 1..369: note = derived and/or modified sequence opt2 from anti-influenza_Chain
  source 1..369: mol_type = other RNA
caggtccagctcgtccagtccggcgccgaggtcaagaagcccggctcctccgtccgcgtctcctgcaaggcctccggctccatcttccgcaactacgccatgtcctgggtccgccaggcccccggccagggcctcgagtggatgggcggcatcatcgccatcttcggcacccccaagtacgcccagaagttccagggccgcgtcaccatcaccgccgacgagtccacctccaccgtctacatggagctctccggcctccgctccgaggacaccgccatgtactactgcgcccgcatcccccactacaacttcggctccggctcctacttcgactactggggccagggcaccctcgtcaccgtctcctcc

SEQ ID NO: 20269 - RNA, 369 nt, synthetic construct
  misc_feature 1..369: note = derived and/or modified sequence opt2 from anti-influenza_Chain
  source 1..369: mol_type = other RNA
cagctccagctccaggagtccggcccccgcctcgtcaagccctccgagaccctctccctcacctgctccgtctccggcgtctccatctcctcctccaactactactggggctggatccgccagccccccggcaagggcctcgagtggatcggcaccatctaccactccggctccacctactacaacccctccctcaagtcccgcctcatcatctccgtcgacacctccaagaaccagttctacctccagctcacctccctcaccgccgccgactccgccgtctactactgcgccaccggcggcggcttcggctggtcccagacctacttcggctactggggccagggcaccctcgtcaccgcctcctcc

SEQ ID NO: 20270 - RNA, 369 nt, synthetic construct
  misc_feature 1..369: note = derived and/or modified sequence opt2 from anti-influenza_Chain
  source 1..369: mol_type = other RNA
gaggtccagctccagcagtccggccccgagctcgtcaagcccggcgcctccgtcaagatgtcctgcaaggcctccggctacaccttcacctccttcatcatgtactgggtcaagcagaagcccggccagggcctcgagtggctcggctacatcgacccctacaacgacggcaccaagtacaacgagaagttcgagggcaaggccaccctcacctccgacaagtcctcctccaccgcctacatggagctctcctccctcacctccgaggactccgccgtctactactgcgccaagcgcggcaactacggcaacggcttcgcctactggggccagggcaccctcgtcaccgtctccgccgccaagacctcc

SEQ ID NO: 20271 - RNA, 369 nt, synthetic construct
  misc_feature 1..369: note = derived and/or modified sequence opt2 from anti-influenza_Chain
  source 1..369: mol_type = other RNA
caggtccagctcctcgagtccggcggcgacgtcgtccagcccggcacctccctccgcctctcctgcgccgcctccggcttctccctctggacctccggcatgcactgggtccgccaggcccccggcaagggcctcgagtgggtcgccgtcatgtcctacgacgagaccaagaagtactacgccgactccgtccgcggccgcttctccatctcccgcgacaactcccgcaacaccctctacctccagatgaactccctccgcgtcgaggacaccgccgtctacttctgcgccaagccccgcctcgactacctcgactacttccacgccgccgactcctggggccagggcaccctcgtctccgtctcctcc

SEQ ID NO: 20272 - RNA, 369 nt, synthetic construct
  misc_feature 1..369: note = derived and/or modified sequence opt2 from anti-influenza_Chain
  source 1..369: mol_type = other RNA
caggtccagctcgtcgagtccggcgccgaggtccgcaagcccggcgagtccctccgcatctcctgcaaggcccacggcgactccttcacctcctactggatcggctgggtccgccagctccccggcaagggcctcgagtggatggccgtcatctacccccgcgactccgagaccaagttctcccccgccttccacggccaggtctccatctccgtcgacaagtccacctccaccgtccacctccagtggaactccctcaaggcctccgacaccgccgtctactactgcgcccgctcccccggctactccggctacctctacggctggttcgacccctggggccagggcacccccgtcaccgtctcctcc

SEQ ID NO: 20273 - RNA, 369 nt, synthetic construct
  misc_feature 1..369: note = derived and/or modified sequence opt2 from anti-influenza_Chain
  source 1..369: mol_type = other RNA
caggtccagctcgtcgagtccggccccggcctcgtcaagccctccgagaccctctccctcacctgcaccgtctccggcgactccgtcatcaactccgcctactactgggactggatccgccagccccccggcaagggcctcgagtgggtcggctccgtctactactccggcatcacctactacaacccctccctcaagtcccgcgtcaccatctccgtcgacacctccaagaaccagttctccctccgcctctcctacgtcaccgccgccgacaccgccctctactactgcgcccgccgcggcggcggctggcagtactactacggcatggacgtctggggccagggcaccaccgtcaccgtctcctcc

SEQ ID NO: 20274 - RNA, 369 nt, synthetic construct
  misc_feature 1..369: note = derived and/or modified sequence opt2 from anti-influenza_Chain
  source 1..369: mol_type = other RNA
caggtccagctcgtccagtccggcgccgaggtcaagaagcccggcgcctccgtcaaggtctcctgcaaggcctccggctacatcttcaccggctactacatccactgggtccgccaggcccccggccagggcctcgagtggatgggccgcatcgaccccaacggctccggcaccacctacgcccagaagttccagggccgcgtcaccctcaccatggacacctccatcaccaccgcctacatggagctctcccgcctccgcttcgacgacaccgccatctactactgcgcccgctgggactggaacttcgacctctacctcggctggttcgacccctggggccagggcacccccgtcaccgtcgcctcc

SEQ ID NO: 20275 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgcctccgtcaaggtctcctgcaaggcctccggctacatcttcaccggctactacatccactgggtccgccaggcccccggccagggcctcgagtggatgggccgcatcgaccccaacggcgccggcaccacctacgcccagaagttccagggccgcgtcaccctcaccatggacacctccatcaccaccgcctacatggagctctcccgcctccgcttcgacgacaccgccatctactactgcgcccgctgggactggaacttcgacctctacctcggctggttcgacccctggggccagggcacccccgtcaccgtcgcctcc

SEQ ID NO: 20276 - RNA, 369 nt, synthetic construct
  misc_feature 1..369: note = derived and/or modified sequence opt2 from anti-influenza_Chain
  source 1..369: mol_type = other RNA
caggtccagctcgtccagtccggcgccgaggtcaagaagcccggcgcctccgtcaaggtctcctgcaaggcctccggctacaccttcaacgcccaccacatgcactgggtccgccaggcccccggccagggcctcggctggatgggctggatcgaccccaacaacgacggcaccatctacgcccagaagttccagggccgcgtcaccctcaccatggacacctccatccacaccgcctacatggagctctccggcctccgctacgacgacaccgccatctactactgcgtccgctgggcctggaacttcgacttcttcctcggctggttcgacccctggggccagggcaccctcgtcaccgtcgcctcc

SEQ ID NO: 20277 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgactccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20278 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgacgccgacgccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20279 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgagtccgagaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20280 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgacgccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20281 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggctcctccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20282 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgactccgacgccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20283 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgacaccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20284 - RNA, 369 nt, synthetic construct
  misc_feature 1..369: note = derived and/or modified sequence opt2 from anti-influenza_Chain
  source 1..369: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgagtccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctcc

SEQ ID NO: 20285 - RNA, 372 nt, synthetic construct
  misc_feature 1..372: note = derived and/or modified sequence opt2 from anti-influenza_Chain
  source 1..372: mol_type = other RNA
caggtccagctcgtccagtccggcgccgaggtcaagaagcccggctcctccgtcaaggtctcctgcaaggcctccggcggcatcttcatctcccaggccatctcctgggtccgccaggcccccggccagggcctcgagtggatgggcggcatcatccccatgttcggcgccaccaactacgcccagaagttccagggccgcgtcaccatcaccgccgacaagtccaccaacaccgtctacatggagctctcctccctcacctccgaggacaccgccgtctactactgcgcccgcctcggctccggctcctaccacaacggccccaactggttcgacccctggggccagggcaccctcgtcaccgtctcctcc

SEQ ID NO: 20286 - RNA, 372 nt, synthetic construct
  misc_feature 1..372: note = derived and/or modified sequence opt2 from anti-influenza_Chain
  source 1..372: mol_type = other RNA
caggtccagctccaggagtccggccccggcctcgtcaagccctccgagaccctctccctcaactgcgccgtctccggcggctccatctccaactactactggtcctggatccgccagccccccggcaagggcctcgagtggatcggctacatctcctacaacggccgccccaagtacaacccctccctcacctcccgcgtcaccatctccgtcgacacctccaaggaccagttctccctcgagctccgctccgtcaccgccgccgacaccgccctctactactgcgcccgcgagacccgcttcggcgagctcctctccccctacgacgccttcgagatctggggccagggcaccatggtcaccgtctcctcc

SEQ ID NO: 20287 - RNA, 372 nt, synthetic construct
  misc_feature 1..372: note = derived and/or modified sequence opt2 from anti-influenza_Chain
  source 1..372: mol_type = other RNA
caggtccagctccaggagtccggccccggcctcgtcaagccctccgagaccctctccctcacctgcaccgtctccggcggctccgtctcctccgagacctactactggtcctggatccgccagccccccggcaagggcctcgagtggatcggctacatctactacatcggcaacaccgactaccgcccctccctcaagtcccgcgtcaccatctccctcgacacctccaagaaccagttctccctcaagctctcctccgtcaccgccgccgacaccgccgtctactactgcgcccgcggcgcctactacgactcctccggctaccccgccttctacatctggggccagggcaccatggtcaccgtctcctcc

SEQ ID NO: 20288 - RNA, 372 nt, synthetic construct
  misc_feature 1..372: note = derived and/or modified sequence opt2 from anti-influenza_Chain
  source 1..372: mol_type = other RNA
caggtccagctccaggagtccggccccggcctcgtcaagccctccgagaccctctccctcacctgcgccgtctccggcgtctccatctccaacatcgacttctactggggctggatccgccagccccccggcaagggcctcgagtggatcggcaacatctactacaccggcatcaccttctacaacccctccctctcctcccgcgtcgccatctccatcgacacctccaagaaccagttctccctcaccctcacctccgtcaccgccgccgacaccgccatgtactactgcgcccgccactacggcgactccgaggccatcaacgacgccttcgacatctggggccagggcaccatgctcaccgtctcctcc

SEQ ID NO: 20289 - RNA, 372 nt, synthetic construct
  misc_feature 1..372: note = derived and/or modified sequence opt2 from anti-influenza_Chain
  source 1..372: mol_type = other RNA
caggtccagctcgtcgagtccggcgccgaggtcaagaagttcggcgcctccgtcaaggtctcctgcaaggcctccggctacaccctcatcgactactacatgcactgggtccgcgtcgcccccggccagggcctcgagtggatgggctggatcaaccccatcaacggcggcaccaactacgcccagaagttccagggccgcgtcaccatgacccgcgacacctccatcaacaccgcctacatggacctctcctccctccgctccgacgacaccgccatgtactactgcacccgcggccgccccatcggccgcaactgggagccccgcgacaaggactactggggccagggcacccccgtcaccgtctcctcc

SEQ ID NO: 20290 - RNA, 372 nt, synthetic construct
  misc_feature 1..372: note = derived and/or modified sequence opt2 from anti-influenza_Chain
  source 1..372: mol_type = other RNA
caggtccagctcgtccagtccggcgccgaggtcaagaagcccggctcctccgtcaccgtctcctgcaagacctccggccacaccttcatctcctacgccatctcctggctccgccaggcccccggccagggcctcgagtggatgggcggcatcgtccccatcttcggcaccgtcaactacacccagaagttccagggccgcctcaccatcaccgccgacgagtccacctccaccgcctacatggacctctcccgcctcaccttcgaggacaccgccatctacttctgcgcccgcgaggccggctaccactcctccttctccggcgtctacttcgactactggggccagggcaccctcctcaccgtctcctcc

SEQ ID NO: 20291 - RNA, 372 nt, synthetic construct
  misc_feature 1..372: note = derived and/or modified sequence opt2 from anti-influenza_Chain
  source 1..372: mol_type = other RNA
gaggtccagctccagcagtccggccccgagctcgtcaagcccggcgcctccgtcaagatctcctgcaaggcctccggctacaccttcaccgactacaacatgcactgggtcaagcagtccctcggcaagtccctcgagtggatcggctacatctaccccaacaacggcggcaccggctacaaccagaagttcgagtccaaggccaccctcaccgtcgacaactcctcctccaccgcctacatggagctccgcaccctcacctccgaggactccgccgtctactactgcgtccgctccggcgcctactacttcaactacctcgtcccctacttcgactactggggccagggcaccaccctcaccgtctcctcc

SEQ ID NO: 20292 - RNA, 372 nt, synthetic construct
  misc_feature 1..372: note = derived and/or modified sequence opt2 from anti-influenza_Chain
  source 1..372: mol_type = other RNA
gaggtccagctccagcagtccggccccgagctcgtcaagcccggcgcctccgtcaagatctcctgcaaggcctccggctacaccttcaccggctacaacatgcactgggtcaagcagtcccacggcaagtccctcgagtggatcggcaagatctaccccaacaacggcgtcaccggctacaaccaggagttccgctccaaggccaccctcaccgtcgacaactcctcctccaccgcctacatggagctccgctccctcacctccgaggactccgccatctacttctgcgtccgctccggcgcctactacgtcaactacctcgtcccctacttcgactactggggccagggcaccaccctcaccgtctcctcc

SEQ ID NO: 20293 - RNA, 375 nt, synthetic construct
  misc_feature 1..375: note = derived and/or modified sequence opt2 from anti-influenza_Chain
  source 1..375: mol_type = other RNA
caggtccagctcgtccagtccggcgccgaggtcaagaagcccggctcctccgtcaaggtctcctgcaaggcctccggcgtcacctcctccaactaccccatcacctgggtccgccaggcccccggccagggcctcgagtggatgggcggcgtcctccccctcttcggcgtcaccaactacgcccagaagttccagggccgcgtcaccatctccgccgacaagtccaccaacaccgcctacatggagctctcctccctccgctccgaggacaccgccgtctactactgcgcccgcggcaagcgccccggctactgctccggcggcgtctgctcctccgactactggggccagggcaccctcgtcaccgtctcctcc

SEQ ID NO: 20294 - RNA, 375 nt, synthetic construct
  misc_feature 1..375: note = derived and/or modified sequence opt2 from anti-influenza_Chain
  source 1..375: mol_type = other RNA
caggtccagctccaggagtccggccccggcctcgtcaagccctcccagaccctctccctcacctgcaccgtctccggcggctccatctcctccggcacctactactggtcctggatccgccaccaccccggcaagggcctcgagtggatcggctacatctaccactccggctccgcctactacaacccctccctcgagtcccgcgtcaccatgtccgtcgacacctccaagaaccagttctccctcaagctctcctccgtcaccgccgccgacaccgccatctactactgcgcccgcgccgagaacctcctctccccctacctcgccgagggcttcgacccctggggccagggcaccctcgtcaccgtctcctcc

SEQ ID NO: 20295 - RNA, 375 nt, synthetic construct
  misc_feature 1..375: note = derived and/or modified sequence opt2 from anti-influenza_Chain
  source 1..375: mol_type = other RNA
gaggtccagctcgtccagtccggcgccgaggtcaagaagcccggcgagtccctcaagatctcctgccaggcctccggctactccttcacctcccgctggatcggctgggtccgccagatgcccggcaagggcctcgagtgggtcggcttcatctacccctccgactccgacgtccgctactccccctccttccgcggccaggtcaccatctccgccgacaagtccatctccaccgcctacctccagtggtcctccctcaaggcctccgacaccgccatgtacttctgcgcccgcctcggcggcaacaaggactacggcgactacctctggtacttcgacctctggggccgcggcgccctcgtcaccgtctcctcc

SEQ ID NO: 20296 - RNA, 375 nt, synthetic construct
  misc_feature 1..375: note = derived and/or modified sequence opt2 from anti-influenza_Chain
  source 1..375: mol_type = other RNA
caggtccagctcgtcgagtccggcggcggcgtcgtccagcccggccgctccctccgcctctcctgcgccgcctccggcttcaccttctcctcctacggcatgcactgggtccgccaggcccccggcaagggcctcgagtgggtcgccgtcatctggtacgacggcgacaacaagtactacggcgactccgtcaagggccgcttcaccatctcccgcgacaactccaagaacaccctcttcctccagatgaactccctccgcgccgaggacaccgccgtctactactgcgccaaggacaccgccgaccacggcgactacgtcgacctcggcttcttcgacgcctggggccagggcaccctcgtcaccgtctcctcc

SEQ ID NO: 20297 - RNA, 375 nt, synthetic construct
  misc_feature 1..375: note = derived and/or modified sequence opt2 from anti-influenza_Chain
  source 1..375: mol_type = other RNA
gaggtccagctcgtccagtccggcgccgagctcaagatgcccggcgagtccctcaagatctcctgcaaggcctccggctacaccttcaccaactactggatcggctgggtccgccagacccccggcaagggcctcgagtggatgggcatcatcttcccccccgactcccagacctcctactccccctccttccagggccaggtcaccttctccgtcgacaactccatctccgtcgcctacatccagtggtcctccctcaaggcctccgacaccgccatctactactgcgcccgctccggcatcttcgactggtccgcccccctcgtcgaggccttcgacatctggggccagggcaccgtcgtcaccgtctcctcc

SEQ ID NO: 20298 - RNA, 375 nt, synthetic construct
  misc_feature 1..375: note = derived and/or modified sequence opt2 from anti-influenza_Chain
  source 1..375: mol_type = other RNA
gaggtccagctcgtccagtccggcgccgaggtcaagaagcccggcgagtccctcaagatctcctgcaagggctccggctactccttctccgactactggatcggctgggtccgccagatgcccggcgagggcctcgagtggatgggcatcatctaccccgcctcctccgagatccgctactccccctccttccagggcctcgtcaccatctccgccgacaagtccatcaacaccgcctccctccagtggtcctccctcaaggcctccgacaccgccatctactactgcgcccgccacgcctcctgctccgcccgctcctgctactggggccccgtcgactactggggccagggcaccctcgtcaccgtctcctcc

SEQ ID NO: 20299 - RNA, 375 nt, synthetic construct
  misc_feature 1..375: note = derived and/or modified sequence opt2 from anti-influenza_Chain
  source 1..375: mol_type = other RNA
caggtccagctcgtcgagtccggcggcggcgtcgtccagcccggccgctccctccgcctctcctgcgccgcctccgagatcaccttcatcacctacgccatgcactgggtccgccaggcccccggcaagggcctcgagtgggtcgccctcatctccgacgacggctccaacaagttctacgccgactccgtcaagggccgcttcaccatctcccgcgacaactccaagaacaccctctacctccagatgaactccctccgcgccgaggacaccgccgcctactactgcgcccgcgagggcgtctacttcgactccggcacctaccgcggctacttcgactactggggccaggagaccctcgtcaccgtctcctcc

SEQ ID NO: 20300 - RNA, 375 nt, synthetic construct
  misc_feature 1..375: note = derived and/or modified sequence opt2 from anti-influenza_Chain
  source 1..375: mol_type = other RNA
caggtccagctccaggagtccggccccggcctcgtcaagccctcccagaccctctccctcacctgcaccgtctccggcggctccatctcctccggcaactactactggaactgggtccgccagcaccccggcaagggcctcgagtggatcggctacatctactaccgcggctccaccttctacaacccctccctcaagtcccgcgtcaccatctccatcgacacctccaagaaccagttctccctccgcctctcctccgtcaccgccgccgacaccgccgtctactactgcgccaaggacacccgctcctccctcgacaactaccagtacggcatggacgtctggggccagggcaccaccgtcaccgtctcctcc

SEQ ID NO: 20301 - RNA, 375 nt, synthetic construct
  misc_feature 1..375: note = derived and/or modified sequence opt2 from anti-influenza_Chain
  source 1..375: mol_type = other RNA
gaggtccagctcctcgagtccggcggcggcctcgtccagcccggcggctccctccgcctctcctgcgccgcctccggcttctccttctccacctacgccatgtcctgggtccgccaggcccccggcaagggcctcgagtgggtctccggcatctccggctccggcgagtccacctactacgccgactccgtcaagggccgcttcaccgtctcccgcgacaactccaagaacaccctctacctccagatgaactccctccgcgccgaggacaccgccgtctactactgcgccaagcagggcgaccacatcgcctggctcctccgcggcatcaacttcgactactggggccagggcgtcctcgtcaccgtctcctcc

SEQ ID NO: 20302 - RNA, 375 nt, synthetic construct
  misc_feature 1..375: note = derived and/or modified sequence opt2 from anti-influenza_Chain
  source 1..375: mol_type = other RNA
caggtccagctcgtcgagtccggcggcggcgtcgtccagcccggccgctccctccgcctctcctgcgccgcctccggcttcgccttccacaaccgcgccatgcactgggtccgccaggcccccggcaagggcctcgagtgggtcgccctcatctacttcgacggctccaagcagtactacgccgactccgtcaagggccgcttcaccatctcccgcgacaactccaagaacaccgtcttcctccagatgaactccctccgccccgaggacaccgccgtctactactgcgccgtccccggccccatcttcggcatcttccccccctggtcctacttcgaccactggggccagggcatcctcgtcaccgtctcctcc

SEQ ID NO: 20303 - RNA, 375 nt, synthetic construct
  misc_feature 1..375: note = derived and/or modified sequence opt2 from anti-influenza_Chain
  source 1..375: mol_type = other RNA
gaggtccagctcgtcgagtccggcggcggcgtcgtccagcccggccgctccctccgcctctcctgcgccgcctccggcttcgccttccacaaccgcgccatgcactgggtccgccaggcccccggcaagggcctcgagtgggtcgccctcatctacttcgacggctccaagcagtactacgccgactccgtcaagggccgcttcaccatctcccgcgacaactccaagaacaccgtcttcctccagatgaactccctccgccccgaggacaccgccgtctactactgcgccgtccccggccccatcttcggcatcttccccccctggtcctacttcgaccactggggccagggcatcctcgtcaccgtctcctcc

SEQ ID NO: 20304 - RNA, 375 nt, synthetic construct
  misc_feature 1..375: note = derived and/or modified sequence opt2 from anti-influenza_Chain
  source 1..375: mol_type = other RNA
gaggtccagctcgtccagtccggcggcggcgtcgtccagcccggcaagtccctccgcctctcctgcgccgcctccggcctcaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctcc

SEQ ID NO: 20305 - RNA, 375 nt, synthetic construct
  misc_feature 1..375: note = derived and/or modified sequence opt2 from anti-influenza_Chain
  source 1..375: mol_type = other RNA
caggtccagctcgtcgagtccggcggcggcgtcgtccagcccggcaagtccctccgcctctcctgcgccgcctccggcctcaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctcc

SEQ ID NO: 20306 - RNA, 375 nt, synthetic construct
  misc_feature 1..375: note = derived and/or modified sequence opt2 from anti-influenza_Chain
  source 1..375: mol_type = other RNA
caggtccagctcgtcgagtccggcggcggcgtcgtccagcccggcaagtccccccgcctctcctgcgccgcctccggccccaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctcc

SEQ ID NO: 20307 - RNA, 375 nt, synthetic construct
  misc_feature 1..375: note = derived and/or modified sequence opt2 from anti-influenza_Chain
  source 1..375: mol_type = other RNA
gaggtccagctcgtcgagtccggcggcggcgtcgtccagcccggcaagtccctccgcctctcctgcgccgcctccggcctcaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctcc

SEQ ID NO: 20308 - RNA, 375 nt, synthetic construct
  misc_feature 1..375: note = derived and/or modified sequence opt2 from anti-influenza_Chain
  source 1..375: mol_type = other RNA
caggtccagctcgtccagtccggcgccgagctcaagcgccccggcgcctccgtcaaggtctcctgcaagacctccggctactccttcaacaactacggcatcaactgggtccgccaggcccccggccagggcctcgagtggatgggctggatctccgcctacaccggcaacacccactacgccaagaacttcgagggccgcgtcaccctcaccaccgacacctccacctccaccgcctacatggaggtccgctccctccgctccgacgactccgccgtctacttctgcgcccgcgccatgatccagggcgtcgtcaccctctacctccgccccggcgactactggggccagggcaccctcgtcaccgtctcctcc

SEQ ID NO: 20309 - RNA, 375 nt, synthetic construct
  misc_feature 1..375: note = derived and/or modified sequence opt2 from anti-influenza_Chain
  source 1..375: mol_type = other RNA
caggtccagctcgtccagtccggcgccgaggtcaagcagcccggcgcctccgtcaaggtctcctgcaaggcctccggctacaccttcaacgcctactacatccactgggtccgccaggcccccggccagggcctcgagtggatgggctggatcaaccccaacttcggcggcacccactacgcccgcaagttccagggccgcgtcaccatgacccgcgacgcctccatcaacaccgcctacatggagctcgaccgcctcatctccgacgacaccgccgtctactactgcgtccgctggcgcgccgccgccgtcatcatggaccagttctacaagatggacgtctggggccagggcaccctcgtcaccgtctcctcc

SEQ ID NO: 20310 - RNA, 375 nt, synthetic construct
  misc_feature 1..375: note = derived and/or modified sequence opt2 from anti-influenza_Chain
  source 1..375: mol_type = other RNA
caggtccagctcgtccagtccggccccgagctcaagaagcccggctcctccgtcaagctctcctgcatggccaccggcggcaccttcatcaactacgccttctcctgggtccgccaggcccccggccagggcctcgagtggctcggcggcatcatccccgtctacggcacctccaaccacgtcgagaagctccagggccgcgtcaccatcaccgccgacgcctccaccaacaccgcctacatggagctctccggcctccgcttcgacgacaccgccgtctacttctgcgccgcctccaccgccacctccggcacctactacgccatgcgccccttcgacttctggggccagggcaccctcgtctccgtctcctcc

SEQ ID NO: 20311 - RNA, 378 nt, synthetic construct
  misc_feature 1..378: note = derived and/or modified sequence opt2 from anti-influenza_Chain
  source 1..378: mol_type = other RNA
gaggtccagctcgtcgagtccggcggcggcgtcgtccagcccggcggctccctccgcctctcctgcatcgcctccgccttcaacctcggcatcttcggcatgcactgggtccgccaggcccccggcaagggcctcgagtgggtcgccttcatccgctacgacggcggcaagaccttctacgccgactccgtcaagggccgcttcaccatctcccgcgacaactccaagaacaccctctacctccagatgaactccctccgcaccgaggacaccgccctctactactgcgcccgcgacgccaccgccgactactacggccccggctcctaccccaactggctcgacccctggggccagggcaccctcgtcaccgtctcc

SEQ ID NO: 20312 - RNA, 378 nt, synthetic construct
  misc_feature 1..378: note = derived and/or modified sequence opt2 from anti-influenza_Chain
  source 1..378: mol_type = other RNA
gaggtccagctcgtcgagtccggccccgccctcgtcaagcccacccagaccctcaccctcacctgctccttctccggcttctccctctccacctccggcatgtccgtctcctggatccgccagccccccggcaaggccctcgagtggctcgccctcatcgactgggacgacgacacctactacatcacctactcctcctccctcaagacccgcctcaccatctccaaggacacctccaagtcccaggtcgtcctcaccatgaccaacatggaccccgtcgacaccgccacctactactgcgcccgcaccctccgcgtctccggcgactacgtccgcgacttcgacctctggggccgcggcaccctcgtcaccgtctcc

SEQ ID NO: 20313 - RNA, 378 nt, synthetic construct
  misc_feature 1..378: note = derived and/or modified sequence opt2 from anti-influenza_Chain
  source 1..378: mol_type = other RNA
caggtccagctccaggagtccggccccggcctcgtcaagccctccgagaccctctccctcacctgcaccgtctccggcggctccatcaactcctactactggaactggatccgccagccccccggcaagggcctcgagtggatcggctacatctaccactccggctccaccaactacaacccctccctcaagtcccgcgtcaccatctccgtcgacacctccaagaaccagttctccctccagctctcctccgtcaccgccgccgacaccgccgtctactactgcgcccgcctccgcaccgactacggcgaccccgactccgtctactactacggcatggacgtctggggccagggcaccaccgtcaccgtctcctcc

SEQ ID NO: 20314 - RNA, 378 nt, synthetic construct
  misc_feature 1..378: note = derived and/or modified sequence opt2 from anti-influenza_Chain
  source 1..378: mol_type = other RNA
caggtccacctcgtccagtccggcgccgaggtccgcaagcccggcgactccgtcaaggtctcctgcaagacctccggctacaccttctccacctaccccgtcgcctgggtccgccaggtccccggccagggcctcgagtggatgggctggatctccacctacaacggcaacaccaacttcgcccagaacttccagggccgcgtcaccctcaccaccgacaccaccaccaacaccgcctacatggaggtccgctccctcaagttcgacgacaccgccgtctactactgcgcccgcgtcgagggctcctaccgcgacttctggaacaaccagaaccgcttcgacccctggggccagggcaccctcgtcaccgtctcctcc

SEQ ID NO: 20315 - RNA, 378 nt, synthetic construct
  misc_feature 1..378: note = derived and/or modified sequence opt2 from anti-influenza_Chain
  source 1..378: mol_type = other RNA
gaggtccagctcgtcgagtccggcgccgaggtcaagaagcccggcgcctccgtcaaggtctcctgcaaggcctccggctacaccttcacctccttcgacatcaactgggtccgccaggcccccggccagggcctcgagtggatgggctggatgacccccacctccggcaagaccggctacgcccagaagttccagggccgcatcaccatgacccgcaacacctccatcaacaccgcctacatggagctctcctccctccgctccgaggacaccgccgtctacttctgcgcccgcggccccgagcgccgcaccaccatcttcgacgtcatcctcgactggttcgacccctggggccagggcaccctcgtcaccgtctcc

SEQ ID NO: 20316 - RNA, 378 nt, synthetic construct
  misc_feature 1..378: note = derived and/or modified sequence opt2 from anti-influenza_Chain
  source 1..378: mol_type = other RNA
caggtccagctcgtccagtccggcgccgaggtcaagaagcccggctcctccgtcaaggtctcctgcaaggcctccggcggcttcttctcctcctacgccatctcctgggtccgccaggcccccggccagggcctcgagtggatgggcggcgtcatccccatcttccgcaccgccaactacgcccagaacttccagggccgcgtcaccatcaccgccgacgagttcacctcctacatggagctctcctccctccgctccgacgacaccgccgtctactactgcgcccgcctcaactaccacgactccggcacctactacaacgccccccgcggctggttcgacccctggggccagggcaccctcgtcaccgtctcctcc

SEQ ID NO: 20317 - RNA, 378 nt, synthetic construct
  misc_feature 1..378: note = derived and/or modified sequence opt2 from anti-influenza_Chain
  source 1..378: mol_type = other RNA
caggtccagctcgtccagtccggcgccgaggtcaagaagcccggctcctccgtcaaggtctcctgcaaggcctccggcggcgccttctccaactacgccatctcctgggtccgccaggcccccggccagggcctcgagtggatgggcggcatcatccccatcttcggcaccaccaactacgcccagaagttccagggccgcgtcaccatcaccgccgacaagttcaccaccatcgcctacatggagctccgctccctccgctccgaggacaccgccgtctactactgcgcccgccacggcggcgtctactactacggctccgcctcctccggctggttcgacccctggggccagggcaccctcgtcaccgtctcctcc

SEQ ID NO: 20318 - RNA, 378 nt, synthetic construct
  misc_feature 1..378: note = derived and/or modified sequence opt2 from anti-influenza_Chain
  source 1..378: mol_type = other RNA
caggtccagctcctcgagtccggcggcggcgtcgtccgccccggccgctccctccgcctcgcctgcgccggctccggcttcaccttctccgcctacgccatgcactgggtccgccaggcccccggcaagggcctcgagtgggtcgcccacacctcctacgacggccgcgactcctactacgtcgactccgtcaagggccgcttcaccatctcccgcgacgactccaagaacaccctctacctccagatgaactccctccgccccgaggacaccgccgtctactactgcgccaaggtcggcccctacaccggctacgacgactacaactactacggcatggacgtctggggccacggcaccaccgtcaccgtctcctcc

SEQ ID NO: 20319 - RNA, 378 nt, synthetic construct
  misc_feature 1..378: note = derived and/or modified sequence opt2 from anti-influenza_Chain
  source 1..378: mol_type = other RNA
caggtccagctcgtcgagtccggcggcggcgtcgtccagcccggcggctccctccgcctctcctgcgccgcctccggcttcaacttcgacgagtacgtcatgtactgggtccgccagtcccccggcaagggcctcgagtgggtctccctcatcggcgccgacggccgcggcacctacaactccgactccgtcaagggccgcttcaccatctcccgcgacaaccgcaagaactccctctacctccagatgaactccctccgctccgacgacaccgccctctactactgcgccaaggtcgagcgctccttctacgacggctccggctacggcgacgccctcgagatctggggccagggcaccatggtcaccgtctcctcc

SEQ ID NO: 20320 - RNA, 381 nt, synthetic construct
  misc_feature 1..381: note = derived and/or modified sequence opt2 from anti-influenza_Chain
  source 1..381: mol_type = other RNA
gaggtccagctcctcgagtccggcggcggcctcgtccaccccggcggctccctccgcctctcctgcgccgcctccggcttcaccttctccaactacgccatgtcctgggtccgccaggcccccggcaagggcctcgagtgggtctcctccatcaactccggcggcggcgccacctactacgccgactccgtcaagggccgcttcaccatctcccgcgacaactccaagaacaccctctccctccagatgaactccctccgcgccgaggacaccgccgtctactactgcgccaaggagggcggcaacaccatcttcggcctcgtcaccatggcctactacttcgactcctggggccagggcaccctcgtcaccgtctcctcc

SEQ ID NO: 20321 - RNA, 381 nt, synthetic construct
  misc_feature 1..381: note = derived and/or modified sequence opt2 from anti-influenza_Chain
  source 1..381: mol_type = other RNA
cagccccagctccaggagtccggccccggcctcgtccgcccctccgagaccctctccctcacctgcaccgtctccggcgactccgtcacccgcggcggcttctactggggctggatccgccagccccccggcaagggcctcgagtggatcggctccatctactacaactacaacatctaccactccccctccctcaagtcccgcgtctccctctccgtcgacacctccaagaaccaggtctccctcaagctcgcctccgtcaccgccgccgacaccgccgtctactactgcgcccgccactacccctactacgacctccccaccggcttctactcccagttcgacttctggggccagggcacccccgtcaccgtctcctcc

SEQ ID NO: 20322 - RNA, 381 nt, synthetic construct
  misc_feature 1..381: note = derived and/or modified sequence opt2 from anti-influenza_Chain
  source 1..381: mol_type = other RNA
tggtggcagctcgtccagtccggcgccgaggtcaagaagcccggctcctccgtcaaggtctcctgcaaggcctccggcggcaccttctcctcctacgacatctcctgggtccgccaggcccccggccagggcctcgagtggatgggcggcatcatccccatctacggcaccgccaactacgcccagaagttccagggccgcgtcaccatcaccgccgacgagtccacctccaccgcctacatggagctctcctccctccgctccgaggacaccgccgtctactactgcgcccgcgccggcggcgactcctccggctactacggcgccctcggccgcttcttccagcactggggccagggcaccctcgtcaccgtctcctcc

SEQ ID NO: 20323 - RNA, 381 nt, synthetic construct
  misc_feature 1..381: note = derived and/or modified sequence opt2 from anti-influenza_Chain
  source 1..381: mol_type = other RNA
gaggtccagctcgtccagtccggcggcgccgtcgtccagcccggccgctccctccgcctctcctgcgccgcctccggcttcaccttctccatctacgccatgcactgggtccgccagacccccggcaagggcctcgagtgggtcgccctcatctcctacgacggcaacaacaagtactacgccgactccgtcaagggccgcttcaccatctcccgcgacaactacaagaacaccctctacctccagatgaagggcctccgcgccgaggacaccgccctctactactgcgcccgccgcatcaccgagaagggctactacaacgactccggccgccccaactggttcgacccctggggccagggcaccctcgtcaccgtctcc

SEQ ID NO: 20324 - RNA, 381 nt, synthetic construct
  misc_feature 1..381: note = derived and/or modified sequence opt2 from anti-influenza_Chain
  source 1..381: mol_type = other RNA
caggtccagctccagcagtccggcccccgcctcgtcaagccctcccagaccctctccctcacctgcgccatctccggcgactccgtctccggcgactccggcacctggaactggatccgccagtccccctcccgcggcctcgagtggctcggccgcacctactaccgctccaagtggtacaacgactacgccgagtccgtcaagtcccgcatcgtcatcaaggccgacacctccaagaacgagttctccctccagctcaactccgtcacccccgaggacaccgccatctactactgcgcccgcgccggcgtcaagatcttcggcctcatcgtcggcgccctcgacaactggggccgcggcaccctcgtcaccgtctcctcc

SEQ ID NO: 20325 - RNA, 381 nt, synthetic construct
  misc_feature 1..381: note = derived and/or modified sequence opt2 from anti-influenza_Chain
  source 1..381: mol_type = other RNA
caggtccagctccagcagtggggcgccggcctcctcaagccctccgagaccctctccctcacctgcaccgtctccggcggctccctcaccgactactcctggaactggatccgccagccccccggcaagggcctcgagtggatcggcgacaccctccacaacggctacaccaactacaacccctccctccgcggccgcgtctccatctccatcgacacctccaagaaccaggtctccctccgcctcacctccgtcaccgccgccgacaccgccctctactactgcgcccgcggctccggcggctacggcggcttcgactacttcggcaagctccgcacctgggacttctggggccagggcaccctcgtcaccgtctcctcc

SEQ ID NO: 20326 - RNA, 381 nt, synthetic construct
  misc_feature 1..381: note = derived and/or modified sequence opt2 from anti-influenza_Chain
  source 1..381: mol_type = other RNA
caggtccagctcgtccagtccggcgccgaggtccgcaagcccggcgagtccctccgcatctcctgccgcggctccggctacaacttccccaagtactggatcggctgggtccgccagatgcccggcaagggcctcgagtggatgggcatgatctaccccggcgactccgacgtccgctacaacccctccttccagggccaggtcaccatctccgccgacgagtccatcaacaccgcctacctccagtggtcctccctccgcacctccgacaccgcccgctactactgcgcccgccacctcggccagcagctcgtctccaacacctactactactacggcatggacgtctggggccagggcaccaccgtcaccgtctcctcc

SEQ ID NO: 20327 - RNA, 384 nt, synthetic construct
  misc_feature 1..384: note = derived and/or modified sequence opt2 from anti-influenza_Chain
  source 1..384: mol_type = other RNA
cagatccagctccaggagtccggccccggcctcgtcaagccctcccagaccctctccctcacctgcgccatctccggcgactccgtctcctccaacaacgccgtctggaactggatccgccagtccccctcccgcggcctcgagtggctcggccgcacctactaccgctccaagtggtacaacgactacgccgagtccgtcaagtcccgcatcaccgtcaaccccgacacctccaagaaccagttctccctccacctcaagtccgtcacccccgaggacaccgccgtcttctactgcgtccgctccggccacatcaccgtcttcggcgtcaacgtcgacgccttcgacatgtggggccagggcaccatggtcaccgtctcctcc

SEQ ID NO: 20328 - RNA, 384 nt, synthetic construct
  misc_feature 1..384: note = derived and/or modified sequence opt2 from anti-influenza_Chain
  source 1..384: mol_type = other RNA
caggtccagctccaggagtccggccccggcctcgtcaagccctcccagaccctctccctcacctgcgccatctccggcgactccgtctcctccaacaacgccgtctggaactggatccgccagtccccctcccgcggcctcgagtggctcggccgcacctactaccgctccaagtggtacaacgactacgccgagtccgtcaagtcccgcatcaccgtcaaccccgacacctccaagaaccagttctccctccacctcaagtccgtcacccccgaggacaccgccgtcttctactgcgtccgctccggccacatcaccgtcttcggcgtcaacgtcgacgccttcgacatgtggggccagggcaccatggtcaccgtctcctcc

SEQ ID NO: 20329 - RNA, 384 nt, synthetic construct
  misc_feature 1..384: note = derived and/or modified sequence opt2 from anti-influenza_Chain
  source 1..384: mol_type = other RNA
caggtccagctccagcagtccggccccggcctcgtcaagccctcccagaccctctccctcacctgcgccatctccggcgaccgcgtctcctccaactccgccgtctggaactggatccgccagtccccctcccgcggcctcgagtggctcggccgcacctactaccgctccaagtggtactacgactacgccgagtccgtcaagtcccgcatcgtcatcgaccccgacacctccaagaaccaggtctccctccagctcaactccgtcacccccgaggactccgccatctactactgcgcccgcggcggccacatcaccgtcttcggcctcaacatcgacgcctacgacatctggggccagggcgccaaggtcaccgtctcctcc

SEQ ID NO: 20330 - RNA, 384 nt, synthetic construct
  misc_feature 1..384: note = derived and/or modified sequence opt2 from anti-influenza_Chain
  source 1..384: mol_type = other RNA
caggtccagctccagcagtccggccccggcctcgtcaagccctcccagaccctctccctcacctgcgccatctccggcgaccgcgtctcctccaactccgccgtctggaactggatccgccagtccccctcccgcggcctcgagtggctcggccgcacctactaccgctccaagtggtactacgactacgccgagtccgtcaagtcccgcatcgtcatcgaccccgacacctccaagaaccaggtctccctccagctcaactccgtcacccccgaggactccgccatctactactgcgcccgcggcggccacatcaccgtcttcggcctcaacatcgacgcctacgacatctggggccagggcgccatggtcaccgtctcctcc

SEQ ID NO: 20331 - RNA, 384 nt, synthetic construct
  misc_feature 1..384: note = derived and/or modified sequence opt2 from anti-influenza_Chain
  source 1..384: mol_type = other RNA
caggtccagctccagcagtccggccccggcctcgtcaagccctcccagaccctctccctcacctgcgccatctccggcgaccgcgtctcctccaactccgccgtctggaactggatccgccagtccccctcccgcggcctcgagtggctcggccgcacctactaccgctccaagtggtactacgactacgccgagtccgtcaagtcccgcatcgtcatcgaccccgacacctccaagaaccaggtctccctccagctcaactccgtcacccccgaggactccgccatctactactgcgcccgcggcggccacatcaccgagttcggcctcaacatcgacgcctacgacatctggggccagggcgccatggtcaccgtctcctcc

SEQ ID NO: 20332 - RNA, 384 nt, synthetic construct
  misc_feature 1..384: note = derived and/or modified sequence opt2 from anti-influenza_Chain
  source 1..384: mol_type = other RNA
caggtccagctccagcagtccggccccggcctcgtcaagccctcccagaccctctccctcacctgcgtcatctccggcgacaccgtctcctccaaccgcgccacctggaactggatgcgccagtcccccctccgcggcctcgagtggctcggccgcacctactaccgctccaagtggtacaacgactacgccgtctccgtcaagtcccgcgtcgtcatcaaccccgacacctccaagaaccaggtctccctccagctcaacaccgtcacccccgacgactccggcgtctacttctgcgcccgcggcggccacatcaccgtcttcggcgtcaacatcgacgccttcgacatctggggcctcggcaccaaggtcaccgtctcctcc

SEQ ID NO: 20333 - RNA, 384 nt, synthetic construct
  misc_feature 1..384: note = derived and/or modified sequence opt2 from anti-influenza_Chain
  source 1..384: mol_type = other RNA
caggtcgagctccagcagtccggccccggcctcgtcaagccctcccagaccctctccctcacctgcgccatctccggcgactccgtctcctccaactccgccacctggaactggatccgccagtccccctcccgcggcctcgagtggctcggccgcacctactaccgctccaagtggtacaacgactacgccgacttcctcaagcgccgcatcaccatcaaccccgacacctccaacaacgaggtctccctccgcctcacctccgtcacccccgacgacaccgccctctactactgcgcccgcggcggccacatcaccgtcttcggcgtcaacatcgacgccttcgacgtctggggccagggcaccatggccaccgtctcctcc

SEQ ID NO: 20334 - RNA, 384 nt, synthetic construct
  misc_feature 1..384: note = derived and/or modified sequence opt2 from anti-influenza_Chain
  source 1..384: mol_type = other RNA
caggtccagctccagcagtccggccccggcctcgtcaagccctcccagaccctctccctcacctgcgccatctccggcgactccgtctcctccaactccgccacctggaactggatccgccagtccccctcccgcggcctcgagtggctcggccgcacctactaccgctccaagtggtacaacgactacgccgacttcctcaagcgccgcatcaccatcaaccccgacacctccaacaacgaggtctccctccgcctcacctccgtcacccccgacgacaccgccctctactactgcgcccgcggcggccacatcaccgtcttcggcgtcaacatcgacgccttcgacgtctggggccagggcaccatggtcaccgtctcctcc

SEQ ID NO: 20335 - RNA, 384 nt, synthetic construct
  misc_feature 1..384: note = derived and/or modified sequence opt2 from anti-influenza_Chain
  source 1..384: mol_type = other RNA
caggtccagctccagcagtccggccccggcctcgtcaagccctcccagaccctctccctcacctgcgccatctccggcgactccgtctcctcctacaacgccgtctggaactggatccgccagtccccctcccgcggcctcgagtggctcggccgcacctactaccgctccggctggtacaacgactacgccgagtccgtcaagtcccgcatcaccatcaaccccgacacctccaagaaccagttctccctccagctcaactccgtcacccccgaggacaccgccgtctactactgcgcccgctccggccacatcaccgtcttcggcgtcaacgtcgacgccttcgacatgtggggccagggcaccatggtcaccgtctcctcc

SEQ ID NO: 20336 - RNA, 384 nt, synthetic construct
  misc_feature 1..384: note = derived and/or modified sequence opt2 from anti-influenza_Chain
  source 1..384: mol_type = other RNA
caggtccagctccagcagtccggccccggcctcgtcaagccctcccagaccctctccctcacctgcgccatctccggcgactccgtctcctccaacaacgccgtctggaactggatccgccagtccccctcccgcggcctcgagtggctcggccgcacctactaccgctccaagtggtacaacgactacgccgagtccgtcaagtcccgcatcaccatcaaccccgacacctccaagaaccagttctccctccagctcaactccgtcacccccgaggacaccgccgtctactactgcgcccgctccggccacatcaccgtcttcggcgtcaacgtcgacgccttcgacatgtggggccagggcaccaccgtcaccgtctcctcc

SEQ ID NO: 20337 - RNA, 384 nt, synthetic construct
  misc_feature 1..384: note = derived and/or modified sequence opt2 from anti-influenza_Chain
  source 1..384: mol_type = other RNA
cgcggccagctcgtccagtccggcggcggcgtcgtccagcccggccgctccctccgcctctcctgcgccgcctccggcttcgtcttcaacgtcttcggcatccactgggtccgccaggcccccggcaagggcctcgagtggctcgccaccatctcctacgacggcctcaacaagtactacgccgactccgtcaagggccgcatcaccatctcccgcgacaactccaagaacaccctctacctccagatgaactccctccgcgccgaggacaccgccgtctactactgcgtccgcgactccgaggagtccacctactacggcgactacatgtgggtctacaactggttcgacctctggggccagggcaccctcgtcaccgtctcc

SEQ ID NO: 20338 - RNA, 384 nt, synthetic construct
  misc_feature 1..384: note = derived and/or modified sequence opt2 from anti-influenza_Chain
  source 1..384: mol_type = other RNA
caggtccagctccagcagtggggctccggcctcctcaagccctccgagaccctctccctcacctgcgccgtctacggcggctccttccgcgacgactactggacctggatccgccagccccccggcaagggcctcgagtggatcggcgagatcaaccactccggccgcaccaactacaacccctccctcaagtcccgcgtcaccatctccgtcgacacctccctcaagcagttctccctcaaggtcatctccgtcaccgccgccgacaccgccgtctactactgcgcccgcggcacctcccacgtctcccgctacttcgactggctcccccccaccaactggttcgacccctggggccagggcacccaggtcaccgtctcctcc

SEQ ID NO: 20339 - RNA, 384 nt, synthetic construct
  misc_feature 1..384: note = derived and/or modified sequence opt2 from anti-influenza_Chain
  source 1..384: mol_type = other RNA
caggtccagctccagcagtggggcgccggcctcctcaagccctccgagaccctctccctctcctgcgccgtcttcggcggctccttctccgactactactggacctggatccgccagccccccggcaagggcctcgagtggatcggcgagatcaagcactccggccgcaccaactacaacccctccctcgagtcccgcgtcaccatctccgtcgacacctccaagaaccagttctccctcaagctctcctccgtcaccgccgccgacaccgccatctactactgcgcccgcggcaccgaccccgacaccgagggctactgccgctccggctcctgctccgccttcgacttctggggccagggcaccctcgtcaccgtctcctcc

SEQ ID NO: 20340 - RNA, 384 nt, synthetic construct
  misc_feature 1..384: note = derived and/or modified sequence opt2 from anti-influenza_Chain
  source 1..384: mol_type = other RNA
caggtccagctccagcagtggggcgccggcctcctcaagccctccgagaccctctccctcacctgcggcgtctacggcggctccctctccgactactactggtcctggatccgccagccccccggcaagggcctcgagtggatcggcgagatcaaccactccggcggcaccaactacaacccctccctcaagcgccgcgtcaccatctccgtcgacacctccaagaagcagttctccctcaagatgaactccgtcaccgccgccgacaccgccgtctactactgcgcccgcggcaccgaccccgacaccgaggtctactgccgcgccggcaactgcgccgccttcgacttctggggccagggcaccctcgtcaccgtctcctcc

SEQ ID NO: 20341 - RNA, 384 nt, synthetic construct
  misc_feature 1..384: note = derived and/or modified sequence opt2 from anti-influenza_Chain
  source 1..384: mol_type = other RNA
caggtccagctccaggagtccggccccggcctcgtcaagccctcccagaccctctccctcacctgcaccgtctccggcgactccatctcctccgtcgaccactactggtcctggatccgccagcaccccgtcaagggcctcgagtggatcggcttcatgtactactccgcctccacctactacaacccctccctcaagtcccgcgtcaccatctccaccgacacctccaagaaccagttctccctccgcctctcctccgtcaccgccgccgacaccgccgtctactactgcgcccgcggcacctgcgccggcgactgctccctccactactactactacggcctcgacgtctggggccagggccgcaccgtcaccgtctcctcc

SEQ ID NO: 20342 - RNA, 384 nt, synthetic construct
  misc_feature 1..384: note = derived and/or modified sequence opt2 from anti-influenza_Chain
  source 1..384: mol_type = other RNA
gaggtcgccctcgtcgagtccggcgccgaggtcaagaagcccggctcctccgtcaaggtctcctgcaaggcctccggccacatcttctccggctacgccatctcctgggtccgccaggcccccggccagggcctcgagtggatgggcggcatcatccccatcttcggcaccaccaactacgcccagaagttccagggccgcgtcaccatcaccgccgaccagtccacctccaccgcctacatggacctctccaacctccgctccgaggacaccgccgtctactactgcgcccgcgtcaaggacggctactgcaccctcacctcctgccccgtcggctggtacttcgacctctggggccgcggcaccctcgtcaccgtctcctcc

SEQ ID NO: 20343 - RNA, 384 nt, synthetic construct
  misc_feature 1..384: note = derived and/or modified sequence opt2 from anti-influenza_Chain
  source 1..384: mol_type = other RNA
gaggtccagctcgtcgagtccggcgccgaggtcaagaagcccggctcctccgtcaaggtctcctgcaaggcctccggccacatcttctccggctacgccatctcctgggtccgccaggcccccggccagggcctcgagtggatgggcggcatcatccccatcttcggcaccaccaactacgcccagaagttccagggccgcgtcaccatcaccgccgaccagtccacctccaccgcctacatggacctctccaacctccgctccgaggacaccgccgtctactactgcgcccgcgtcaaggacggctactgcaccctcacctcctgccccgtcggctggtacttcgacctctggggccgcggcaccctcgtcaccgtctcctcc

SEQ ID NO: 20344 - RNA, 384 nt, synthetic construct
  misc_feature 1..384: note = derived and/or modified sequence opt2 from anti-influenza_Chain
  source 1..384: mol_type = other RNA
caggtccagctcgtccagtccggcgccgaggtccgcaagcccggcgcctccgtcaaggtctcctgcaaggcctccggctacaccttcacccgccacggcatctcctgggtccgccaggcccccggccagggcctcgagtggatgggctggatctccgcctacaccggcgacaccgactacgcccagaagttccagggccgcgtcaccatgaccaccgacacctccaccaacaccgcctacatggagctccgctccctccgctccgacgacgccgccgtctactactgcgcccgcctccgcctccagggcgaggtcgtcgtccccccctcccagtccaactggttcgacccctggggccagggcaccctcgtcaccgtctcctcc

SEQ ID NO: 20345 - RNA, 384 nt, synthetic construct
  misc_feature 1..384: note = derived and/or modified sequence opt2 from anti-influenza_Chain
  source 1..384: mol_type = other RNA
caggtccagctcgtcgagtccggccccggcctcatgaagccctccgagaccctctccctcacctgcaccgtctccggcggctccgtctccaactactactggtcctggatccgccagccccccggcaagggcctcgagtggatcggctacgtcttctactccggctcctccaactacaacccctccctcaacaacccctccctcaagtcccgcgtcaccatctccatcgacacctccaacaaccagttctccctcaagctctcctccgtcaccgccgccgacaccgccgtctactactgcgcccgcggccgcgtcaactccggctacgactggggccccaacttcgactcctggggccagggcgccctcgtcaccgtctcctcc

SEQ ID NO: 20346 - RNA, 384 nt, synthetic construct
  misc_feature 1..384: note = derived and/or modified sequence opt2 from anti-influenza_Chain
  source 1..384: mol_type = other RNA
caggtccagctcgtccagtccggcgccgaggtcaagaagcccggctcctccgtcaaggtctcctgcaaggcctccggcggcaccttctcctactacgccatctcctgggtccgccaggcccccggccagggcctcgagtggatgggcggcatcatccccatcgtcggcaccgcccactacacccagaagttccagggccgcgtcaccatcaccgccgacgagtccacctccaccgcctacatggagctctcctccctccgctccgaggacaccgccgtctacttctgcgcccgcgccgccgacgagtccgtcgagtccctcaccatcaaggccttccgcaccaactaccactggggccagggcaccctcgtcaccgtctcctcc

SEQ ID NO: 20347 - RNA, 387 nt, synthetic construct
  misc_feature 1..387: note = derived and/or modified sequence opt2 from anti-influenza_Chain
  source 1..387: mol_type = other RNA
gaggtccagctcgtcgagtccggcggcggcgccgtccagcccggcgagtccctcaagctcccctgcgccgcctccggcttcaccttctccaactacggcatgcactgggtccgccaggcccccggcaagggcctcgagtgggtcgccgtcatctcctacgacggctccaacaagtactacgccgactccgtcaagggccgcttcaccatctcccgcgacaactccaaggacaccctctacctccagatgaactccctccgcgccgaggacaccgccctcttctactgcgccaaggagcgccccctccgcctcctccgctacttcgactggctctccggcggcgccaacgactactggggccagggcaccctcgtcaccgtctcctcc

SEQ ID NO: 20348 - RNA, 387 nt, synthetic construct
  misc_feature 1..387: note = derived and/or modified sequence opt2 from anti-influenza_Chain
  source 1..387: mol_type = other RNA
gaggtccagctcgtcgagtccggcggcggcgccgtccagcccggcgagtccctcaagctctcctgcgccgcctccggcttcaccttctccaactacggcatgcactgggtccgccaggcccccggcaagggcctcgagtgggtcgccgtcatctcctacgacggctccaacaagtactacgccgactccgtcaagggccgcttcaccatctcccgcgacaactccaaggacaccctctacctccagatgaactccctccgcgccgaggacaccgccctcttctactgcgccaaggagcgccccctccgcctcctccgctacttcgactggctctccggcggcgccaacgactactggggccagggcaccctcgtcaccgtctcctcc

SEQ ID NO: 20349 - RNA, 387 nt, synthetic construct
  misc_feature 1..387: note = derived and/or modified sequence opt2 from anti-influenza_Chain
  source 1..387: mol_type = other RNA
caggtccagctcgtcgagtccggcggcggcgtcgtccagcccggccgctccctccgcctctcctgcgccgtctccggcttcaccttctcctcctacgccatgcactgggtccgccaggcccccggcaagggcctcgagtgggtcgccgtcatctcctacgacggctccaaccagtactacgccgactccgtcaagggccgcttcaccatctcccgcgacaactccaagaacaccctctacctccagatgaactccctccgcgccgaggacaccgccctctactactgcgccaaggacccccgcctccgccacctcctctacttccccttcacctccatgatctacttcgactactggggccagggcaccctcgtcaccgtctcctcc

SEQ ID NO: 20350 - RNA, 387 nt, synthetic construct
  misc_feature 1..387: note = derived and/or modified sequence opt2 from anti-influenza_Chain
  source 1..387: mol_type = other RNA
caggtccagctcgtccagtccggcggcggcgtcgtccagcccggccgctccctccgcctctcctgcgtcgcctccggcttcaccttctccacctacgccatgcactgggtccgccaggcccccggccgcggcctcgagtgggtcgccgtcatctcctacgacgccaactacaagtactacgccgactccgtcaagggccgcttctccatctcccgcgacaactcccagaacaccctccacctcgagatgaacaccctccgcaccgaggacaccgccctctactactgcgccaaggactcccagctccgctccctcctctacttcgagtggctctcccagggctacttcgagccctggggccagggcaccctcgtcaccgtcacctcc

SEQ ID NO: 20351 - RNA, 387 nt, synthetic construct
  misc_feature 1..387: note = derived and/or modified sequence opt2 from anti-influenza_Chain
  source 1..387: mol_type = other RNA
caggtccagctcgtccagtccggcggcggcgtcgtccagcccggccgctccctccgcctctcctgcgtcgcctccggcttcaccttctccacctacgccatgcactgggtccgccaggcccccggccgcggcctcgagtgggtcgccgtcatctcctacgacggcaactacaagtactacgccgactccgtcaagggccgcttctccatctcccgcgacaactccaactccaccctccacctcgagatgaacaccctccgcaccgaggacaccgccctctactactgcgccaaggactcccagctccgctccctcctctacttcgagtggctctcccagggctacttcgacccctggggccagggcaccctcgtcaccgtcacctcc

SEQ ID NO: 20352 - RNA, 387 nt, synthetic construct
  misc_feature 1..387: note = derived and/or modified sequence opt2 from anti-influenza_Chain
  source 1..387: mol_type = other RNA
caggtccagctcgtccagtccggcgccgaggtcaagaagcccggctcctccgtcaccgtctcctgcaaggcctccggcggcaccttctccaactacggcatctcctgggtccgccaggcccccggccagggcctcgactggatgggcggcatcatccccctcttcggcaccgccaactacgcccagaagttccagggccgcgtcaccatcaccgccgacgagtccacctcctcctccaacatggagctctcctccctccgctccgaggacaccgccgtctactactgcgcccgcgacgtccacaactacgacttcctcaccggctaccccctccacctctacggcatggacgtctggggccagggcaccaccgtcaccgtctcctcc

SEQ ID NO: 20353 - RNA, 387 nt, synthetic construct
  misc_feature 1..387: note = derived and/or modified sequence opt2 from anti-influenza_Chain
  source 1..387: mol_type = other RNA
caggtccagctccaggagtccggccccggcctcgtcaagccctccgagaccctctccctcatctgcgccgtctccggcgcctccatctcctcctcctactggtcctggatccgccagccccccggcaagggcctcgagtggatcggctacatctactactccggcgtcaccaagtacaacccctccctcaagtcccgcgtcaccctctccgtcgacacctccaagaaccacttctccctcaagctctcctacgtcaccgccgccgacaccgccgtctactactgcgcccgcaacctccccgacatcgccgtcgtcaccgccgtccaggacgccacccccgtctggttcgacccctggggccccggcaccctcgtctccgtctcctcc

SEQ ID NO: 20354 - RNA, 387 nt, synthetic construct
  misc_feature 1..387: note = derived and/or modified sequence opt2 from anti-influenza_Chain
  source 1..387: mol_type = other RNA
gaggtccagctcgtcgagtccggcggcggcctcgtccagcccggccgctccctccgcctctcctgcgccgcctccggcttcaccttctccgacttctggatgtcctgggtccgccaggcccccggcaagggcctcgagtgggtcgccaacatcgaccaggacggcaacgagcgcttctacgccgactccgtcaagggccgcttcaccatctcccgcgacaacgccaagaactccctctacctccagatgacctccctccgcgccgacgacaccgccgtctactactgcgcccgcgacggccgcgagggctacttctacggctccggctccttctacaacctcaagggcctcaactggggccagggcaccctcctcaccgtctcctcc

SEQ ID NO: 20355 - RNA, 387 nt, synthetic construct
  misc_feature 1..387: note = derived and/or modified sequence opt2 from anti-influenza_Chain
  source 1..387: mol_type = other RNA
gaggtcctcatggtcgagtccggcggcggcctcgtccagcccggcggctccgtccgcctctcctgcgtcgcctccggcttctccttctcctcccactggatgacctgggtccgccaggcccccggcaagggcctcgagtgggtcgccaacatcgaggacgacggcggcgacaagtactacgtcgactccgtcaagggccgcttcatcatctcccgcgacaacgccaagaactccgtctacctccagatgaactccctccgcgccgaggacaccgccgtctacttctgcgcccgcggctccggctcctccgaccgctccgactacgacccccactactactactacctcgacgtctggggcaagggcgccaccgtcaccgtctcctcc

SEQ ID NO: 20356 - RNA, 387 nt, synthetic construct
  misc_feature 1..387: note = derived and/or modified sequence opt2 from anti-influenza_Chain
  source 1..387: mol_type = other RNA
gaggtccagctcgtcgagtccggcggcgacctcgtccagcccggccgctccctcaagctctcctgcaccggctccggcttcaccttcggcgactacggcgtcacctgggtccgccaggcccccggcaagggcctcgagtgggtcggcttcatccgcacccgcccctggggcggcaccgccgacaccgccgcctccgtcaagggccgcttcaccatctcccgcgacgactccaagtccctcgcctacctccagatgaactccctcaagaccgaggacaccgccgtctactactgctgccgcgacgccccccccaacgtcgaggtcgcctccatgaccaactggtacttcgacctctggggccgcggcaccctcgtcaccgtctcctcc

SEQ ID NO: 20357 - RNA, 387 nt, synthetic construct
  misc_feature 1..387: note = derived and/or modified sequence opt2 from anti-influenza_Chain
  source 1..387: mol_type = other RNA
gaggtccagctcgtccagtccggctccgaggtcaagaagcccggcgagtccctcaagatctcctgcaagggctccggctactccttctccaactactggatcggctgggtccgccacatgcccggcaagggcctcgagtggatgggcatcatctaccccggcgactccgacacccgctactccccctccttccagggccaggtcaccatgtccgccgacaagtcctcctccaccgtctacctccagtggtcctccctcaaggcctccgacaccgccatctactactgcgcccgccgcggcggccactccttcggctacggctccggcggcgacacccactccgagttcgactcctggggccagggcaccctcgtcaccgtctcctcc

SEQ ID NO: 20358 - RNA, 387 nt, synthetic construct
  misc_feature 1..387: note = derived and/or modified sequence opt2 from anti-influenza_Chain
  source 1..387: mol_type = other RNA
caggtccagctcctcgagaccggcggcggcctcgtcaagcccggccagtccctcaagctctcctgcgccgcctccggcttcaccttcacctcctacgccatgcactgggtccgccagccccccggcaagggcctcgagtgggtcgccgtcgtctcctacgacggcaactacaagtactacgccgactccgtccagggccgcttcaccatctcccgcgacaactccaagaacaccctctacctccagatgaactccctccgcgccgaggacaccgccgtctactactgcgccaaggactcccgcctccgctccctcctctacttcgagtggctctcccagggctacttcaacccctggggccagggcaccaccctcaccgtctcctcc

SEQ ID NO: 20359 - RNA, 387 nt, synthetic construct
  misc_feature 1..387: note = derived and/or modified sequence opt2 from anti-influenza_Chain
  source 1..387: mol_type = other RNA
caggtccagctcgtcgagtccggcgccgaggtcaagaagcccggcgcctccgtcaagctctcctgcaccgcctccggctacaacttcgccgcctactacatccactgggtccgccaggcccccggccagggcctcgagtggatgggctggtccaaccccaacaccggcggcgccaactacgcccaggacttccagggccgcgtcaccatgaccgccgtcacctccacctccaccgcctacatggagctctcccgcctcacctccgacgacaccgccctctacttctgcgcccgcgtcccccgcgaccgcctcctcaccctctactacgagtcctccacctacggcttcgactactggggccagggcaccctcgtcaccgtctcctcc

SEQ ID NO: 20360 - RNA, 387 nt, synthetic construct
  misc_feature 1..387: note = derived and/or modified sequence opt2 from anti-influenza_Chain
  source 1..387: mol_type = other RNA
caggtccagctcgtcgagtccggcggcggcctcgtccagcccggcggctccctccgcctctcctgcaccgtctccggcttcaccttcaactcctacgccatgaactgggtccgccaggcccccggcaagggcctcgagtgggtctccggcatccgcggctccggcgagaacacctactacgccgagaccgtcaagggccgcttcaccatctcccgcgacaactccaagaacaccctctacctcgagatgaactccctccgcgccgaggacaccgccgtctactactgcgcccgcaagtggggccgcatgaccgtcttcggcgtcgccaccgaccagctctactacttcgactactggggccagggcaccctcgtcaccgtctcctcc

SEQ ID NO: 20361 - RNA, 387 nt, synthetic construct
  misc_feature 1..387: note = derived and/or modified sequence opt2 from anti-influenza_Chain
  source 1..387: mol_type = other RNA
caggtccagctcgtcgagtccggccccggcctcgtcaagccctcccagaccctctccctcacctgcaccgtctccggcggctccatctccaacggcggctaccactggtcctggatccgccagcaccccggcaagggcctcgagtggatcggcaacatctactaccgcggctccaccttctacgacccctccctcaagtcccgcgtcaccatctccgtcgacacctccaagtcccagttctccctcaagctcacctccgtcaccgccgccgacaccgccgtctactactgcgcccgcatgcccctcgccaactacgacctcctcaccggcctctacatcggcgccttcgacctctggggccagggcaccatggtcaccgtctcctcc

SEQ ID NO: 20362 - RNA, 387 nt, synthetic construct
  misc_feature 1..387: note = derived and/or modified sequence opt2 from anti-influenza_Chain
  source 1..387: mol_type = other RNA
caggtccagctcgtcgagtccggcgccgaggtcaagaagcccggcgcctccgtccgcgtctcctgcaagggctccggctacaccttcaccgcctaccacatgcactgggtccgccaggcccccggccagggcttcgagtgggtcggctggatcaaccccaactccggcgccacctactacacctccaccttcgagggccgcgtcaccatgacccgcgacacctccatcaccaccgcctacatggagctctcctccctccgctccgacgacaccgccgtctactactgcgccaccgacatcgtcgtcgagcgcgacgcctccctcggcggcttcaactcctacggcatggacgtctggggccagggcaccaccgtcaccgtctcctcc

SEQ ID NO: 20363 - RNA, 390 nt, synthetic construct
  misc_feature 1..390: note = derived and/or modified sequence opt2 from anti-influenza_Chain
  source 1..390: mol_type = other RNA
caggtccagctccagcagtggggcgccggcctcctcaagccctccgagaccctctccctcacctgcgccgtctacggcggctccttctccgtctccggctactactggtcctggatccgccagccccccggccgcggcctcgagtggatcggcgagatctcccacggcggctccaccaactacaacccctccctcaagtcccgcgtcaccatctccgtcgacaccaccaagaaccagttctccctccgcctctcctccgtcaccgccgccgacaccgccgtctactactgcgcccgcggcaccgaccccgacaccgaggtctactgccgcgtcggcaactgcgccgccttcgactactggggccagggctccctcgtcaccgtctcctcc

SEQ ID NO: 20364 - RNA, 390 nt, synthetic construct
  misc_feature 1..390: note = derived and/or modified sequence opt2 from anti-influenza_Chain
  source 1..390: mol_type = other RNA
caggtccagctcctcgagtccggccccggcctcgtcaagccctcccagaccctcctcctcacctgcaccgtctccggcgcctccatctccaccggcggcaactactggtcctggatccgccagcaccccggcaaggacctcgagtggatcggctacatcttctactccggcaccaccaagtacaacccctccgtcgacaacccctccctcaagtcccgcgtcaccatgtccgtcgacacctccgagaaccagttctccctcaagctctcctccgtcaccgccgccgacaccgccgtctacttctgcgcccgcggctcccccaactccggctacgactggggcccccacttcgactactggggccagggcaccctcgtcaccgtctcctcc

SEQ ID NO: 20365 - RNA, 390 nt, synthetic construct
  misc_feature 1..390: note = derived and/or modified sequence opt2 from anti-influenza_Chain
  source 1..390: mol_type = other RNA
gaggtccagctcgtcgagtccggcggccacctcgtccagcccggccgctccctccgcctctcctgcgccgcctccggcttcaccttcgaggactacgccatgaactgggtccgccaggcccccggcaagggcctcgagtgggtctccgtcatctcctgggactccggccgcatcggctacgccgactccgtcaagggccgcttcaccatctcccgcgacaacgccaagaactcctcctacctccagatgaactccctccgccccgaggacaccgccctctactactgcgtccgcgacatgctcgcctactactccgacaactccggcaagaagtacaacgtctacggcatggacgtctggggccagggcaccaccgtcaccgtctcctcc

SEQ ID NO: 20366 - RNA, 390 nt, synthetic construct
  misc_feature 1..390: note = derived and/or modified sequence opt2 from anti-influenza_Chain
  source 1..390: mol_type = other RNA
gaggtccagctcgtcgagtccggcggcggcctcgtccagcccggccgctccctccgcctctcctgcgccgtctccggcttcatcttcgaggactacgccatcaactgggtccgccaggcccccggcaagggcctcgagtgggtctccatcatctcctgggactccggccgcatcggctacgccgactccgtccgcggccgcttcaccatctcccgcgacaacgccaagaactcctccttcctccagatgaactccctccgccccgaggacaccgccgtctactactgcgtcaaggacatgctcgcctactactacgacggctccggcatccgctacaacctctacggcatggacgtctggggccagggcaccaccgtcaccgtctcctcc

SEQ ID NO: 20367 - RNA, 390 nt, synthetic construct
  misc_feature 1..390: note = derived and/or modified sequence opt2 from anti-influenza_Chain
  source 1..390: mol_type = other RNA
gaggtccagctcgtcgagtccggcggcggcctcgtccagcccggccgctccctccgcctctcctgcgccgtctccggcttcatcttcgaggactacgccatcaactgggtccgccaggcccccggcaagtgcctcgagtgggtctccatcatctcctgggactccggccgcatcggctacgccgactccgtccgcggccgcttcaccatctcccgcgacaacgccaagaactcctccttcctccagatgaactccctccgccccgaggacaccgccgtctactactgcgtcaaggacatgctcgcctactactacgacggctccggcatccgctacaacctctacggcatggacgtctggggccagggcaccaccgtcaccgtctcctcc

SEQ ID NO: 20368 - RNA, 396 nt, synthetic construct
  misc_feature 1..396: note = derived and/or modified sequence opt2 from anti-influenza_Chain
  source 1..396: mol_type = other RNA
cagatcaccctcaaggagtccggccccaccctcgtcaagcccacccagaccctcaccctcacctgcgtcttctccggcttctccctctccatcaccggcgtccgcgtcggctggatccgccagccccccggcaaggccctcgagtggctcgccctcatctcctgggacgacgagaagcactactccccctccctccagtcccgcctcaccatcaccaaggacacctccaagaaccaggtcgtcctcaccatgaccaacctcgaccccgtcgacaccgccacctactactgcgcccgctccaccgaccgcggccacgtcctccgctacttcggctggatgctccccggcgacgccttcgacgtctggggccagggcaccatggtcaccgtctcctcc

SEQ ID NO: 20369 - RNA, 396 nt, synthetic construct
  misc_feature 1..396: note = derived and/or modified sequence opt2 from anti-influenza_Chain
  source 1..396: mol_type = other RNA
caggtccagctccaggagtccggccccggcctcgtcaagccctccgagaccctctccctcacctgcaccgtctcctccggccccatgtccgactactactggtcctggatccgccagccccccggcaagggcctcgagtggatcggccacgtctccgtctcccacggcggccgcaccaagtccaacccctccgtcatgtcccgcgtcaccatctccgtcgagacctccaagaaccagttctccctcaagctcacctccgtcaccgccgccgacaccgccgtctactactgcgcccgcctcaactactacgaccgctccggctaccactcccccgacggcccctccaacaactggttcgacccctggggccagggcaccctcgtcaccgtctcctcc

SEQ ID NO: 20370 - RNA, 396 nt, synthetic construct
  misc_feature 1..396: note = derived and/or modified sequence opt2 from anti-influenza_Chain
  source 1..396: mol_type = other RNA
caggtccagctcgtccagtccggcgccgaggtcaagaagcccggcgcctccgtcaaggtctcctgcaagacctccggctacaccttcaccgcctacaccatccactgggtccgccaggcccccggccagcgcctcgagtggatgggctggatcaacgccggcaacggccacaccaagtactcccagcgcttcaagggccgcgtcaccatcacccgcgacacctccgcccgcaccacctacatggagctccgctccctcacctccgaggacaccgccctctacttctgcgcccgcggccccgagacctactactacgacaagaccaactggctcaactcccaccccgacgagtacttccagcactggggccacggcacccaggtcaccgtctcctcc

SEQ ID NO: 20371 - RNA, 399 nt, synthetic construct
  misc_feature 1..399: note = derived and/or modified sequence opt2 from anti-influenza_Chain
  source 1..399: mol_type = other RNA
caggtccagctcgtccagtccggctccgaggtcaagaagcccggcgcctccgtcaaggtctcctgcaaggcctccggctacaccttcaccaactacgacatcaactggatccgccaggcccccggccagggcctcgagtggatgggctggatcaaccccaactccggcaccaccggctccgcccagcgcttccagggccgcgtcaccatcaccgtcgacacctccatcaccaccgtctacatggagctctcctccctccgctccgacgacaccgccatctactactgcgcccgcggccgcgagctcctccgcctccagcacttcctcaccgactcccagtccgagcgccgcgactgcttcgacccctggggccagggcaccctcgtcaccgtctcctcc

SEQ ID NO: 20372 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcctctccttcctcaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20373 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcttctccttcctcaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20374 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcctcaccttcctcaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20375 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcttctccttctccaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20376 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcctcaccttctccaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20377 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcttcaccttctccaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20378 - RNA, 402 nt, synthetic construct
  misc_feature 1..402: note = derived and/or modified sequence opt2 from anti-influenza_Chain
  source 1..402: mol_type = other RNA
gaggtccagctcgtcgtctccggcggcggcctcgtcaagcccggcggctccctccgcctctcctgcgccgcctccggcctctccttcctcaacgcctggatgtcctgggtccgccaggcccccggcaagggcctcgagtgggtcggccgcatcaagtccaacaccgacggcggcaccaccgactacgccgcccccgtcaagggccgcttctccatctcccgcgacgactccaagaacatgctcttcctccacatgtcctccctccgcaccgaggacaccgccgtctactactgcgccaccgacggcccctactccgacgacttccgctccggctacgccgcccgctaccgctacttcggcatggacgtctggggccagggcaccaccgtcaccgtctcctcc

SEQ ID NO: 20379 - RNA, 402 nt, synthetic construct
  misc_feature 1..402: note = derived and/or modified sequence opt2 from anti-influenza_Chain
  source 1..402: mol_type = other RNA
gaggtccagctcgtcgtctccggcggcggcctcgtcaagcccggcggctccctccgcctctcctgcgccgcctccggcctctccttcctcaacgcctggatgtcctgggtccgccaggcccccggcaagtgcctcgagtgggtcggccgcatcaagtccaacaccgacggcggcaccaccgactacgccgcccccgtcaagggccgcttctccatctcccgcgacgactccaagaacatgctcttcctccacatgtcctccctccgcaccgaggacaccgccgtctactactgcgccaccgacggcccctactccgacgacttccgctccggctacgccgcccgctaccgctacttcggcatggacgtctggggccagggcaccaccgtcaccgtctcctcc

SEQ ID NO: 20380 - RNA, 402 nt, synthetic construct
  misc_feature 1..402: note = derived and/or modified sequence opt2 from anti-influenza_Chain
  source 1..402: mol_type = other RNA
gaggtccagctcgtcgtctccggcggcggcctcgtcaagcccggcggctccctccgcctctcctgcgccgcctccggcctctccttcctcaacgcctggatgtcctgggtccgccaggcccccggcaagggcctcgagtgggtcggccgcatcaagtccaacaccgacggcggcaccaccgactacgccgcccccgtcaagggccgcttctccatctcccgcgacgactccaagaacatgctcttcctccacatgtcctccctccgcaccgaggacaccgccgtctactactgcgccaccgacggcccctactccgacgacttccgctccggctacgccgcccgctaccgctacttcggcatggacgtctggggctgcggcaccaccgtcaccgtctcctcc

SEQ ID NO: 20381 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcttcaccttcctcaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20382 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcttcaccttcctcaacgcctggatgtcctgggtccgccaggcccccggcaagtgcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggccagggcaccaccgtcaccgtctcctcc

SEQ ID NO: 20383 - RNA, 402 nt, synthetic construct
  misc_feature 1..402: note = derived and/or modified sequence opt2 from anti-influenza_Chain
  source 1..402: mol_type = other RNA
gaggtccagctcgtcgagtccggcggcggcctcgtcaagcccggcggctccctccgcctctcctgcgccgcctccggcttcaccttcctcaacgcctggatgtcctgggtccgccaggcccccggcaagggcctcgagtgggtcggccgcatcaagtccaacaccgacggcggcaccaccgactacgccgcccccgtcaagggccgcttcaccatctcccgcgacgactccaagaacaccctctacctccagatgtcctccctcaagaccgaggacaccgccgtctactactgcaccaccgacggcccctactccgacgacttccgctccggctacgccgcccgctaccgctacttcggcatggacgtctggggctgcggcaccaccgtcaccgtctcctcc

SEQ ID NO: 20384 - RNA, 414 nt, synthetic construct
  misc_feature 1..414: note = derived and/or modified sequence opt2 from anti-influenza_Chain
  source 1..414: mol_type = other RNA
caggtccagctccaggagtccggcggcggcctcgtccagcccggcgagtccctccgcctctcctgcgtcggctccggctcctccttcggcgagtccaccctctcctactacgccgtctcctgggtccgccaggcccccggcaagggcctcgagtggctctccatcatcaacgccggcggcggcgacatcgactacgccgactccgtcgagggccgcttcaccatctcccgcgacaactccaaggagaccctctacctccagatgaccaacctccgcgtcgaggacaccggcgtctactactgcgccaagcacatgtccatgcagcaggtcgtctccgccggctgggagcgcgccgacctcgtcggcgacgccttcgacgtctggggccagggcaccatggtcaccgtctcctcc

SEQ ID NO: 20385 - RNA, 465 nt, synthetic construct
  misc_feature 1..465: note = derived and/or modified sequence opt2 from anti-influenza_Chain
  source 1..465: mol_type = other RNA
ctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaag

SEQ ID NO: 20386 - RNA, 564 nt, synthetic construct
  misc_feature 1..564: note = derived and/or modified sequence opt2 from anti-influenza_Chain
  source 1..564: mol_type = other RNA
aacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaag

SEQ ID NO: 20387 - RNA, 609 nt, synthetic construct
  misc_feature 1..609: note = derived and/or modified sequence opt2 from anti-influenza_Chain
  source 1..609: mol_type = other RNA
atgctccgctccctcgtcctcaacgagaagctccgcgcccgcgtcctcgagcgcgccgaggagttcctcctcaacaacaaggccgacgaggaggtctggttccgcgagctcgtcctctgcatcctcacctccaactcctccttcatctccgcctacaagtccatgaactacatcctcgacaagatcctctacatggacgagaaggagatctccatcctcctccaggagtccggctaccgcttctacaacctcaaggccaagtacctctaccgcgccaagaacctctacggcaaggtcaagaagaccatcaaggagatcgccgacaaggaccagatgcaggcccgcgagttcatcgccacccacatctacggcatcggctacaaggaggcctcccacttcctccgcaacgtcggctacctcgacctcgccatcatcgaccgccacatcctccgcttcatcaacaacctcggcatccccatcaagctcaagtccaagcgcgagtacctcctcgccgagtccctcctccgctccatcgccaacaacctcaacgtccaggtcggcctcctcgacctcttcatcttcttcaagcagaccaacaccatcgtcaag

SEQ ID NO: 20388 - RNA, 615 nt, synthetic construct
  misc_feature 1..615: note = derived and/or modified sequence opt2 from anti-influenza_Chain
  source 1..615: mol_type = other RNA
ggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaagatcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgcc

SEQ ID NO: 20389 - RNA, 639 nt, synthetic construct
  misc_feature 1..639: note = derived and/or modified sequence opt2 from anti-influenza_Chain
  source 1..639: mol_type = other RNA
gagatcgtcctcacccagtcccccggcaccctctccctctcccccggcgagcgcgccaccctctcctgccgcgcctcccagcgcgtctcctcctacctcgcctggtaccagcagaagcccggccaggccccccgcctcctcatctacggcgcctccacccgcgccgccggcatccccgaccgcttctccggctccggctccggcaccgacttcaccctcaccatctcccgcctcgagcccgaggactccgccgtctactactgccagcagtacggccgcacccccctcaccttcggcggcggcaccaaggtcgagatcaagcgcgccgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20390 - RNA, 639 nt, synthetic construct
  misc_feature 1..639: note = derived and/or modified sequence opt2 from anti-influenza_Chain
  source 1..639: mol_type = other RNA
gacatccagatgacccagtccccctcctccctctccgcctccctcggcggcaacgtcaccatcacctgcaaggcctcccaggacatcaacaagtacatcgcctggtaccagcacaagcccggcaagggcccccgcctcgtcatccactacacctccaccctccagcccggcatcccctcccgcttctccggctccggctccggcaccgactactccttctccatctccaacctcgagcccgaggacatcgccacctactactgcctccagtacgacatcctctacaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 20391 - RNA, 642 nt, synthetic construct
  misc_feature 1..642: note = derived and/or modified sequence opt2 from anti-influenza_Chain
  source 1..642: mol_type = other RNA
gacatccagatgacccagtccccctcctccctctccgcctccgtcggcgaccgcgtcaccatcacctgccgcgcctcccagggcatctcctcctacctcgcctggtaccagcagaagcccggcaaggtccccaccctcctcatctacgacgcctccaccctccgctccggcgtcccctcccgcttctccggctccggctccgccaccgacttcaccctcaccatctcctccctccagcccgaggacgtcgccacctactactgccagcgctacaactccgccccccccatcaccttcggccagggcacccgcctcgagatcaagcgcgccgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20392 - RNA, 642 nt, synthetic construct
  misc_feature 1..642: note = derived and/or modified sequence opt2 from anti-influenza_Chain
  source 1..642: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccccccgcaccttcggcggcggcaccaaggtcgagatcaagcgcgccgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20393 - RNA, 642 nt, synthetic construct
  misc_feature 1..642: note = derived and/or modified sequence opt2 from anti-influenza_Chain
  source 1..642: mol_type = other RNA
tcctacgtcctcacccagcccccctccgtctccgtcgcccccggcgagaccgccaccgtcacctgcggcggcaacaacatcggctccaagtccgtccactggtaccagcagaagcccggccaggcccccgtcgtcgtcatctactacgacggcgaccgcccctccggcatccccgagcgcttctccggctccaactccggcgacaccgccaccctcaccatctcccgcgtcgaggccggcgacgaggccgactactactgcctcgtctgggactacacctccgtccactacgtcttcggcaccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgacggctcccccgtcaaggccggcgtcgagaccaccaagccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20394 - RNA, 642 nt, synthetic construct
  misc_feature 1..642: note = derived and/or modified sequence opt2 from anti-influenza_Chain
  source 1..642: mol_type = other RNA
gacatccagatgacccagacctcctcctccctctccgcctccctcggcgaccgcgtcaccatctcctgccgcgcctcccaggacatccgcaactacctcaactggtaccagcagaagcccgacggcaccgtcaagctcctcatctactacacctcccgcctccactccggcgtcccctcccgcttctccgactccggctccggcaccgactactccctcaccatctccaacctcgagcaggaggacctcgccacctacttctgccagcagacctacaccctcccctggaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 20395 - RNA, 645 nt, synthetic construct
  misc_feature 1..645: note = derived and/or modified sequence opt2 from anti-influenza_Chain
  source 1..645: mol_type = other RNA
gacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaag

SEQ ID NO: 20396 - RNA, 645 nt, synthetic construct
  misc_feature 1..645: note = derived and/or modified sequence opt2 from anti-influenza_Chain
  source 1..645: mol_type = other RNA
gacatccagatgacccagtccccctccaccctctccgcctccgtcggcgaccgcgtcaccatcacctgccgcgcctcccagaccatcaacaactacctcgcctggtaccagcagaagcccggcaaggcccccaagctcctcatctacaaggcctcctccctcgagtccggcgtcccctcccgcttctccggctccggctccggcaccgagttcaccctcaccatctcctccctccagcccgacgacttcgccacctactactgccaggagtacaacaacgactcccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20397 - RNA, 645 nt, synthetic construct
  misc_feature 1..645: note = derived and/or modified sequence opt2 from anti-influenza_Chain
  source 1..645: mol_type = other RNA
tccgtcctcacccagcccccctccgcctccggctcccgcggccagtccatcaccatctcctgcaccggctccacctccgacatcggctcctacaactacgtctcctggtaccagcagcaccccggcaccgcccccaaggtcatcctctacgaggtctcccagcgcccctccggcgtccccgaccgcttctccggctccaagtccggcaacaccgccttcctcaccgtctccggcctccaggccgaggacgaggccgactactactgcgcctcctacgccggcaacaacatctacgtcttcggctccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 20398 - RNA, 645 nt, synthetic construct
  misc_feature 1..645: note = derived and/or modified sequence opt2 from anti-influenza_Chain
  source 1..645: mol_type = other RNA
tccgccctcacccagcccccctccgcctccggctcccgcggccagtccatcaccatctcctgcaccggctccacctccgacatcggctcctacaactacgtctcctggtaccagcagcaccccggcaccgcccccaaggtcatcctctacgaggtctcccagcgcccctccggcgtccccgaccgcttctccggctccaagtccggcaacaccgccttcctcaccgtctccggcctccaggccgaggacgaggccgactactactgcgcctcctacgccggcaacaacatctacgtcttcggctccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 20399 - RNA, 648 nt, synthetic construct
  misc_feature 1..648: note = derived and/or modified sequence opt2 from anti-influenza_Chain
  source 1..648: mol_type = other RNA
cagtccgtcctcacccagcccccctccgagtccgtctcccccggccagaccgcctccgtcacctgctccggccacaagctcggcgacaagtacgtctcctggtaccagcagaagcccggccagtcccccgtcctcctcatctaccaggacaaccgccgcccctccggcatccccgagcgcttcatcggctccaactccggcaacaccgccaccctcaccatctccggcacccaggccctcgacgaggccgactactactgccaggcctgggactcctccaccgccgtcttcggcggcggcaccaagctcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20400 - RNA, 648 nt, synthetic construct
  misc_feature 1..648: note = derived and/or modified sequence opt2 from anti-influenza_Chain
  source 1..648: mol_type = other RNA
cagtccgccctcacccagcccgcctccgtctccggctcccccggccagtccatcaccatctcctgcaccggcacctcctccgacgtcggctcctacaacctcgtctcctggtaccagcagcaccccggcaaggcccccaagctcatgatctacgaggtctccaagcgcccctccggcgtctccaaccgcttctccggctccaagtccggcaacaccgcctccctcaccatctccggcctccaggccgaggacgaggccgactactactgccacctctacgtcggctcctccaactgggtcttcggcggcggcaccaagctcgccgtcctcggccagcccaaggccgccccctccgtcaccctcttccccccctcctccaaggagctccaggccaacaaggccaccctcgtctgccccatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 20401 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20402 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtctcccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactaccccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20403 - RNA, 648 nt, synthetic construct
  misc_feature 1..648: note = derived and/or modified sequence opt2 from anti-influenza_Chain
  source 1..648: mol_type = other RNA
gagatcgtcatgacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20404 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtctcctccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20405 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtcgaccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20406 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtctcccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactggcccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20407 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtctcccacaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaacttccccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20408 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaacttccccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20409 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccagtccgtcgactccaacctcgcctggtaccagcagaagcccggccaggccccccgcctcctcgtctactccgcctccacccgcgccaccggcatccccgcccgcttctccggctccggctccggcaccgagttcaccctcgccatctcctccctccagtccgaggacttcgccgtctactactgccagcactacaccaactaccccccccgcctcaccttcggcggcggctccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20410 - RNA, 648 nt, synthetic construct
  misc_feature 1..648: note = derived and/or modified sequence opt2 from anti-influenza_Chain
  source 1..648: mol_type = other RNA
gagaccaccctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactggcccccccgcctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20411 - RNA, 648 nt, synthetic construct; identical to SEQ ID NO: 16292
  misc_feature 1..648: note = derived and/or modified sequence opt2 from anti-influenza_Chain
  source 1..648: mol_type = other RNA

SEQ ID NO: 20412 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagcccgaggacttcgccgtctactactgccagcactactccaactggcccccccgcctcaccttcggcggcggcaccaaggtcgagatcaagcgcaccgtcgccgccccctccgtctccatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20413 - RNA, 648 nt, synthetic construct
  misc_feature 1..648: note = derived and/or modified sequence opt2 from anti-influenza_Chain
  source 1..648: mol_type = other RNA
gagatcgtcatgacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactggcccccccgcctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20414 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaacttccccccccgcctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20415 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgccaccctctcctgccgcgcctcccaggtcatctcccacaacctcgcctggtaccagcagaagcccggccaggccccccgcctcctcatctacggcgcctccacccgcgcctccggcatccccgcccgcttctccggctccggctccggcaccgactacaccctcaccatcacctccctccagtccgaggacttcgccgtctactactgccagcactactccaactaccccccccgcctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20416 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccgccaccctctccgtctcccccggcgagcgcgtcaccctctcctgccgcgcctcccagtccgtcgccaacaacctcgcctggtaccagcagaagcccggccagtccccccgcctcctcatctacggcgcctccacccgcgacaccggcatccccgcccgcttctccggctccggctccggcaccgagttcaccctcaccatctcctccctccagtccgaggacttcgccgtctactactgccagcagtacaacaactggccccccatgtacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20417 - RNA, 648 nt, synthetic construct
  misc_feature 1..648: note = derived and/or modified sequence opt2 from anti-influenza_Chain
  source 1..648: mol_type = other RNA
gacatcgtcatgacccagtccccctccaccctctccgcctccgtcggcgaccgcgtcaccatcacctgccgcgcctcccagtccatcggcaactggctcgcctggtaccagcagaagcccggcaaggcccccaagctcctcatctacaaggtctccaccctcgagtccggcgtcccctcccgcttctccggctccggctccggcaccgagttcaccctcaccatcaactccctccagcccgacgacttcgccacctactactgccagcgctacacctccaactcccagggcttcaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20418 - RNA, 648 nt, synthetic construct
  misc_feature 1..648: note = derived and/or modified sequence opt2 from anti-influenza_Chain
  source 1..648: mol_type = other RNA
gacatccagctcacccagtcccccctctccccccccgtcaccctcggccagcccgcctccatctcctgccgctcctcccagtccctcctctacaccgacggcttcacctacctctcctggtaccaccagcgccccggccagtccccccgccgcctcatctacaagatctccaaccgcgactccggcgtccccgaccgcttctccggctccggctccggcaccgacttcaccctcaagatctcccgcgtcgaggccgaggacgtcggcgtctactactgcatgcaggccacccactggcccctcaccttcggcgagggcaccaaggtcgagatcaagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 20419 - RNA, 648 nt, synthetic construct
  misc_feature 1..648: note = derived and/or modified sequence opt2 from anti-influenza_Chain
  source 1..648: mol_type = other RNA
gagatcgtcctcacccagtcccccggcaccctctccctctcccccggcgagcgcgccaccctctcctgccgcgcctcccagtccgtccgctccaacaacctcgcctggtaccagcacaagcccggccaggccccccgcctcctcatcttcggcgcctcctcccgcgccaccggcatccccgaccgcttctccggctccggctccggcaccgacttcaccctcaccatctcccgcctcgagcccgaggacttcgccgtctactactgccagcagtacggctcctcccccgccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20420 - RNA, 648 nt, synthetic construct
  misc_feature 1..648: note = derived and/or modified sequence opt2 from anti-influenza_Chain
  source 1..648: mol_type = other RNA
cagtccgtcctcacccagcccccctccgcctccggctcccgcggccagtccatcaccatctcctgcaccggctccacctccgacatcggctcctacaactacgtctcctggtaccagcagcaccccggcaccgcccccaaggtcatcctctacgaggtctcccagcgcccctccggcgtccccgaccgcttctccggctccaagtccggcaacaccgccttcctcaccgtctccggcctccagaccgacgacgaggccgactactactgcgcctcctacgccggcaacaacatctacgtcttcggctccggcaccaaggtcaccgtcctcggccagcccaaggccaaccccaccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 20421 - RNA, 651 nt, synthetic construct
  misc_feature 1..651: note = derived and/or modified sequence opt2 from anti-influenza_Chain
  source 1..651: mol_type = other RNA
cagcccgtcctcacccagcccccctccgcctccggctcccccggccagcgcgtcaccatctcctgctccggctcctcctccaacatcggctcctacaccgtcaactggtaccagcagctccccggcaccgcccccaagctcctcatctactccctcaaccagcgcccctccggcgtccccgaccgcttctccggctccaagtccggcacctccgcctccctcgccatctccggcctccagtccgaggacgaggccgtctactactgcgccgcctgggacgactccctctccgcccacgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20422 - RNA, 651 nt, synthetic construct
  misc_feature 1..651: note = derived and/or modified sequence opt2 from anti-influenza_Chain
  source 1..651: mol_type = other RNA
cagcccgtcctcacccagcccccctccgcctccggcacccccggccagcgcgtcaccatctcctgctccggctcctcctccaacatcggctccaacaccgtctcctggtaccagcaggtccccggcaccgcccccaagctcctcatctacggcaacaacgagcgcccctccggcgtccccgaccgcttctccggctccaagtccgccacctccgcctccctcgccatctccggcctccagtccgaggacgaggccgactactactgcgccgcctgggacgactccctcaacggcttctgggtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 20423 - RNA, 651 nt, synthetic construct
  misc_feature 1..651: note = derived and/or modified sequence opt2 from anti-influenza_Chain
  source 1..651: mol_type = other RNA
tcctacgtcctcacccagcccccctccgtctccggcacccccggccagcgcgtcatcatctcctgctccggctactcctccaacatcggctccaacaccgtcaactggtaccagcagttccccggcaccgccccccgcctcctcatctacgccaacaaccagcgcccccccggcgtccccgaccgcttctccggctccaagtccggcacctccgcctccctcgccatctccggcctccagtccgacgacgagtccgactactactgcgccgcctgggacgactccctcaacggccactgggtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20424 - RNA, 654 nt, synthetic construct
  misc_feature 1..654: note = derived and/or modified sequence opt2 from anti-influenza_Chain
  source 1..654: mol_type = other RNA
tcctacgtcctcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccacgccgtcttcggcggcggcacccagctcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20425 - RNA, 654 nt, synthetic construct
  misc_feature 1..654: note = derived and/or modified sequence opt2 from anti-influenza_Chain
  source 1..654: mol_type = other RNA
cagtccgtcgtcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccactacgtcttcggcaccggcaccaaggtcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20426 - RNA, 654 nt, synthetic construct
  misc_feature 1..654: note = derived and/or modified sequence opt2 from anti-influenza_Chain
  source 1..654: mol_type = other RNA
ctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctc

SEQ ID NO: 20427 - RNA, 657 nt, synthetic construct
  misc_feature 1..657: note = derived and/or modified sequence opt2 from anti-influenza_Chain
  source 1..657: mol_type = other RNA
tcctccgagctcacccagcccccctccgcctccggcacccccggccagcgcgtcaccatctcctgctccggctccacctccaacatcggctacaaccccgtctcctggtaccagcaggtccccggcaccgcccccaagctcctcatctactccaacaccgagcgcccctccggcgtccccgaccgcttctccggctccaagtccggcacctccgcctccctcgccatctccggcctccagtccgaggacgaggccgactactactgcgccgcctgggacgacaccctcaacggccccgtcttcggcggcggcaccaaggtcaccgtcctcggccagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20428 - RNA, 657 nt, synthetic construct; identical to SEQ ID NO: 16308
  misc_feature 1..657: note = derived and/or modified sequence opt2 from anti-influenza_Chain
  source 1..657: mol_type = other RNA

SEQ ID NO: 20429 - RNA, 660 nt, synthetic construct
  misc_feature 1..660: note = derived and/or modified sequence opt2 from anti-influenza_Chain
  source 1..660: mol_type = other RNA
tcctacgtcctcacccagcccccctccgcctccggcacccccggccagcgcgtcaccatctcctgctccggctccaccttcaacatcggctccaacgccgtcgactggtaccgccagctccccggcaccgcccccaagctcctcatctactccaacaaccagcgcccctccggcgtccccgaccgcttctccggctcccgctccggcacctccgcctccctcgccatctccggcctccagtccgaggacgaggccgactactactgcgccgcctgggacgacatcctcaacgtccccgtcttcggcggcggcaccaagctcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20430 - RNA, 660 nt, synthetic construct
  misc_feature 1..660: note = derived and/or modified sequence opt2 from anti-influenza_Chain
  source 1..660: mol_type = other RNA
cagtccgccctcacccagcccgccgccgtctccggctcccccggccagtccatcaccatctcctgcaccggcacctcctccgacgtcggcggctacaactacgtctcctggtaccagcagcaccccggcaaggcccccaagctcatgatctacgaggtctccaaccgcccctccggcgtctccaaccgcttctccggctccaagtccggcaacaccgcctccctcaccatctccggcctccaggccgaggacgaggccgactactactgctcctcctacacctcctcctccacctacgtcttcggcaccggcaccaaggtcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20431 - RNA, 660 nt, synthetic construct
  misc_feature 1..660: note = derived and/or modified sequence opt2 from anti-influenza_Chain
  source 1..660: mol_type = other RNA
tcctacgtcctcacccagcccccctccgtctccggcacccccggccagcgcgtcaccatctcctgctccggctcccgctccaacgtcggcgacaactccgtctactggtaccagcacgtccccgagatggcccccaagctcctcgtctacaagaacacccagcgcccctccggcgtccccgcccgcttctccggctccaagtccggcacctccgcctccctcgccatcatcggcctccagtccggcgacgaggccgactactactgcgtcgcctgggacgactccgtcgacggctacgtcttcggctccggcaccaaggtcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20432 - RNA, 660 nt, synthetic construct
  misc_feature 1..660: note = derived and/or modified sequence opt2 from anti-influenza_Chain
  source 1..660: mol_type = other RNA
tcctacgtcctcacccagcccccctccgcctccggcacccccggccagcgcgtcaccatctcctgctccggctcctcctccaacatcggctccaactacgtctactggtaccagcagctccccggcaccgcccccaagctcctcatctaccgcgacggccagcgcccctccggcgtccccgaccgcttctccggctccaagtccggcacctccgcctccctcgccatctccggcctccgctccgacgacgaggccgactactactgcgccacctgggacgacaacctctccggccccgtcttcggcggcggcaccaagctcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20433 - RNA, 660 nt, synthetic construct
  misc_feature 1..660: note = derived and/or modified sequence opt2 from anti-influenza_Chain
  source 1..660: mol_type = other RNA
cagtccgccctcacccagcccgcctccgtctccggctcccccggccagtccatcaccatctcctgcaccggcacctcctccgacgtcggcggctacaactacgtctcctggtaccagcagcaccccggcaaggcccccaagctcatgatctacgaggtctccaaccgcccctccggcgtctccaaccgcttctccggctccaagtccggcaacaccgcctccctcaccatctccggcctccaggccgaggacgaggccgactactactgctcctcctacacctcctcctccaccctcgtcttcggcaccggcaccaaggtcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20434 - RNA, 660 nt, synthetic construct
  misc_feature 1..660: note = derived and/or modified sequence opt2 from anti-influenza_Chain
  source 1..660: mol_type = other RNA
accgtcctcacccagcccccctccgtctccggcgcccccggccagcgcgtcaccatctcctgcaccggctcctcctccaacatcggcgccggctacgacgtccactggtaccagcagctccccggcaccgcccccaagctcctcatctacggcaactccaaccgcccctccggcgtccccgaccgcttctccggctccaagtccggcacctccgccaccctcggcatcaccggcctccagaccggcgacgaggccgactactactgcggcacctgggactcctccctctccgcctacgtcttcggcaccggcaccaaggtcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20435 - RNA, 663 nt, synthetic construct
  misc_feature 1..663: note = derived and/or modified sequence opt2 from anti-influenza_Chain
  source 1..663: mol_type = other RNA
cagtccgtcctcacccagcccccctccgtctccgccgcccccggccagaaggtcaccatctcctgctccggctcctcctccaacatcggcaacgactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccaactactactgcgccacctgggaccgccgccccaccgcctacgtcgtcttcggcggcggcaccaagctcaccgtcctcggcgccgccgccggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20436 - RNA, 675 nt, synthetic construct
  misc_feature 1..675: note = derived and/or modified sequence opt2 from anti-influenza_Chain
  source 1..675: mol_type = other RNA
atggtcggcttcacccccgtcgccctcgccgccctcgccgccaccggcgccctcgccttccccgccggcaacgccaccgagctcgagaagcgccagaccacccccaactccgagggctggcacgacggctactactactcctggtggtccgacggcggcgcccaggccacctacaccaacctcgagggcggcacctacgagatctcctggggcgacggcggcaacctcgtcggcggcaagggctggaaccccggcctcaacgcccgcgccatccacttcgagggcgtctaccagcccaacggcaactcctacctcgccgtctacggctggacccgcaaccccctcgtcgagtactacatcgtcgagaacttcggcacctacgacccctcctccggcgccaccgacctcggcaccgtcgagtgcgacggctccatctaccgcctcggcaagaccacccgcgtcaacgccccctccatcgacggcacccagaccttcgaccagtactggtccgtccgccaggacaagcgcacctccggcaccgtccagaccggctgccacttcgacgcctgggcccgcgccggcctcaacgtcaacggcgaccactactaccagatcgtcgccaccgagggctacttctcctccggctacgcccgcatcaccgtcgccgacgtcggc

SEQ ID NO: 20437 - RNA, 687 nt, synthetic construct
  misc_feature 1..687: note = derived and/or modified sequence opt2 from anti-influenza_Chain
  source 1..687: mol_type = other RNA
cgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20438 - RNA, 696 nt, synthetic construct
  misc_feature 1..696: note = derived and/or modified sequence opt2 from anti-influenza_Chain
  source 1..696: mol_type = other RNA
cacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaag

SEQ ID NO: 20439 - RNA, 699 nt, synthetic construct
  misc_feature 1..699: note = derived and/or modified sequence opt2 from anti-influenza_Chain
  source 1..699: mol_type = other RNA
atgcgcccctccatccagttcctcggcctcctcctcttctggctccacggcggccagtgcgacatccagatgacccagtccccctcctccctctccgcctccctcggcggcaacgtcaccatcacctgcaaggcctcccaggacatcaacaagtacatcgcctggtaccagcacaagcccggcaagggcccccgcctcgtcatccactacacctccaccctccagcccggcatcccctcccgcttctccggctccggctccggcaccgactactccttctccatctccaacctcgagcccgaggacatcgccacctactactgcctccagtacgacatcctctacaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 20440 - RNA, 702 nt, synthetic construct
  misc_feature 1..702: note = derived and/or modified sequence opt2 from anti-influenza_Chain
  source 1..702: mol_type = other RNA
atgatgtcctccgcccagttcctcggcctcctcctcctctgcttccagggcacccgctgcgacatccagatgacccagacctcctcctccctctccgcctccctcggcgaccgcgtcaccatctcctgccgcgcctcccaggacatccgcaactacctcaactggtaccagcagaagcccgacggcaccgtcaagctcctcatctactacacctcccgcctccactccggcgtcccctcccgcttctccgactccggctccggcaccgactactccctcaccatctccaacctcgagcaggaggacctcgccacctacttctgccagcagacctacaccctcccctggaccttcggcggcggcaccaagctcgagatcaagcgcgccgacgccgcccccaccgtctccatcttccccccctcctccgagcagctcacctccggcggcgcctccgtcgtctgcttcctcaacaacttctaccccaaggacatcaacgtcaagtggaagatcgacggctccgagcgccagaacggcgtcctcaactcctggaccgaccaggactccaaggactccacctactccatgtcctccaccctcaccctcaccaaggacgagtacgagcgccacaactcctacacctgcgaggccacccacaagacctccacctcccccatcgtcaagtccttcaaccgcaacgagtgc

SEQ ID NO: 20441 - RNA, 702 nt, synthetic construct
  misc_feature 1..702: note = derived and/or modified sequence opt2 from anti-influenza_Chain
  source 1..702: mol_type = other RNA
atggaggcccccgcccagctcctcttcctcctcctcctctggctccccgacaccaccggcgagatcgtcctcacccagtcccccgccaccctctccctctcccccggcgagcgcgccaccctctcctgccgcgcctccgagaacatctggaacaacctcgcctggtaccagcagaagcccggccaggccccccgcctcctcatctccggcgcctccaccggcgccaccggcgtcccctcccgcttccgcggctccggctcccgcaccgagttcaccctcaccatctcctccctccagtccgaggacttcgccatctacttctgccagcagtacaactcctggccccgcaccttcggccccggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20442 - RNA, 705 nt, synthetic construct
  misc_feature 1..705: note = derived and/or modified sequence opt2 from anti-influenza_Chain
  source 1..705: mol_type = other RNA
atggagacccccgcccagctcctcttcctcctcctcctctggctccccgacaccaccggcgagatcgtcctcacccagtcccccggcaccctctccctctcccccggcgagcgcgccaccctctcctgccgcgcctcccagtccctctcctcctcctccctcgtctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggcaactccccctacaccttcggccagggcacccaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20443 - RNA, 705 nt, synthetic construct
  misc_feature 1..705: note = derived and/or modified sequence opt2 from anti-influenza_Chain
  source 1..705: mol_type = other RNA
atggagacccccgcccagctcctcttcctcctcctcctctggctccccgacaccaccggcgagaccgtcctcacccagtcccccggcaccctctccctctcccccggcgagcgcgccaccctctcctgccgcgcctcccagtccgtctccatctcctacctcgcctggtaccagcgcaagcccggccaggccccccgcctcctcatctacggcgcctcccgccgcgccaccggcatccccgaccgcttctccggctccggctccggcaccgacttcaccctcaccatctcccgcctcgagcccgaggacttcgccgtctactactgccagcagtacggctcctccccctacaccttcggccagggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20444 - RNA, 705 nt, synthetic construct
  misc_feature 1..705: note = derived and/or modified sequence opt2 from anti-influenza_Chain
  source 1..705: mol_type = other RNA
atggcctggatgatgctcctcctcaccctcctcatccactgcaccggctcctgggcccagtccgtcctcacccagcccccctccgtctccgccgcccccggccagaaggtcaccatctcctgctccggctcctcctccaacatcggcaagaactacgtctcctggtaccagcagctccccggcaccgcccccaagctcctcatctacgacaacgacaagcgcccctccggcatccccgaccgcttctccggctccaagtccggcacctccgccaccctcggcatcaccggcctccagaccggcgacgaggccgactaccactgcggcgcctgggactcctccctcaacggcggcgtcttcggcggcggcaccaaggtcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 20445 - RNA, 714 nt, synthetic construct
  misc_feature 1..714: note = derived and/or modified sequence opt2 from anti-influenza_Chain
  source 1..714: mol_type = other RNA
atgatgaagaagaagtcctggttcaccctcatgatcaccggcgtcatctccctcttcttctccgtctccgccttcgccggcaacgtcttctgggagcccctctcctacttcaactcctccacctggcagaaggccgacggctactccaacggccagatgttcaactgcacctggcgcgccaacaacgtcaacttcaccaacgacggcaagctcaagctctccctcacctcccccgccaacaacaagttcgactgcggcgagtaccgctccaccaacaactacggctacggcctctacgaggtctccatgaagcccgccaagaacaccggcatcgtctcctccttcttcacctacaccggcccctcccacggcacccagtgggacgagatcgacatcgagttcctcggcaaggacaccaccaaggtccagttcaactactacaccaacggcgtcggcggccacgagaagatcatcaacctcggcttcgacgcctccacctccttccacacctacgccttcgactggcagcccggctacatcaagtggtacgtcgacggcgtcctcaagcacaccgccaccaccaacatcccctccacccccggcaagatcatgatgaacctctggaacggcaccggcgtcgactcctggctcggctcctacaacggcgccaaccccctctacgccgagtacgactgggtcaagtacacctccaac

SEQ ID NO: 20446 - RNA, 729 nt, synthetic construct
  misc_feature 1..729: note = derived and/or modified sequence opt2 from anti-influenza_Chain
  source 1..729: mol_type = other RNA
caggtccagctcgtccagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcatgggcatgttcggcaccaccaactacgcccagaagttccagggccgcgtcaccatcaccgccgacgagttcacctccgccgcctacatggagctccgctccctccgctccgaggacaccgccgtctactactgcgcccgctcctccggctactaccccgagtacttccaggactggggccagggcaccctcgtcaccgtctcctccggcaccggcggctccggcggcaccggctccggcaccggcggctccacccagtccgtcctcacccagcccccctccgagtccgtctcccccggccagaccgcctccgtcacctgctccggccacaagctcggcgacaagtacgtctcctggtaccagcagaagcccggccagtcccccgtcctcctcatctaccaggacaaccgccgcccctccggcatccccgagcgcttcatcggctccaactccggcaacaccgccaccctcaccatctccggcacccaggccctcgacgaggccgactactactgccaggcctgggactcctccaccgccgtcttcggcggcggcaccaagctcaccgtcctcggc

SEQ ID NO: 20447 - RNA, 729 nt, synthetic construct
  misc_feature 1..729: note = derived and/or modified sequence opt2 from anti-influenza_Chain
  source 1..729: mol_type = other RNA
caggtccagctcgtccagtccggcgccgaggtcaagaagcccggctcctccgtcaaggtctcctgcaaggcctccggcggccccttccgcaacttcgccatcaactgggtccgccaggcccccggccagggcctcgagtggatgggcggcatcatcgccgtcttcggcaccaccaagtacgcccacaagttccagggccgcgtcaccatcaccgccgacgactccaccaacaccgcctacatggagctcggctccctcaagtccgaggacaccgccgtctactactgcgcccgcggcccccactactactcctcctacatggacgtctggggcgagggcaccaccgtcaccgtctcctccggcaccggcggctccggcggcaccggctccggcaccggcggctccaccgacatccagctcacccagtccccctcctccctctccgcctccgtcggcgaccgcgtcaccatcacctgccgcgcctcccagggcatctccacctacctcgcctggtaccagcagaagcccggcaaggtccccaagctcctcatctacgccgcctccaccctccagtccggcgtcccctcccgcttctccggctccggctccggcaccgacttcaccctcaccatctcctccctccagcccgaggacgtcgccacctactactgccagaagtacaactccgccccctccttcggccccggcaccaaggtcgacatcaagcgc

SEQ ID NO: 20448 - RNA, 729 nt, synthetic construct
  misc_feature 1..729: note = derived and/or modified sequence opt2 from anti-influenza_Chain
  source 1..729: mol_type = other RNA
atgtcctaccgcgtcaagcgcatgctcatgctcctcgtcaccggcctcttcctctccctctccaccttcgccgcctccgcctccgcccagaccggcggctccttctacgagcccttcaacaactacaacaccggcctctggcagaaggccgacggctactccaacggcaacatgttcaactgcacctggcgcgccaacaacgtctccatgacctccctcggcgagatgcgcctctccctcacctccccctcctacaacaagttcgactgcggcgagaaccgctccgtccagacctacggctacggcctctacgaggtcaacatgaagcccgccaagaacgtcggcatcgtctcctccttcttcacctacaccggccccaccgacggcaccccctgggacgagatcgacatcgagttcctcggcaaggacaccaccaaggtccagttcaactactacaccaacggcgtcggcaaccacgagaagatcgtcaacctcggcttcgacgccgccaactcctaccacacctacgccttcgactggcagcccaactccatcaagtggtacgtcgacggccagctcaagcacaccgccaccacccagatcccccagacccccggcaagatcatgatgaacctctggaacggcgccggcgtcgacgagtggctcggctcctacaacggcgtcacccccctctcccgctccctccactgggtccgctacaccaagcgc

SEQ ID NO: 20449 - RNA, 735 nt, synthetic construct
  misc_feature 1..735: note = derived and/or modified sequence opt2 from anti-influenza_Chain
  source 1..735: mol_type = other RNA
caggtccagctccagcagtccggcgccgaggtcaagaagcccggctcctccgtcaaggtctcctgcaaggtctccggcgtcatcttctccggctccgccatctcctgggtccgccaggcccccggccagggcctcgagtggatgggcggcatctcccccctcttcggcaccaccaactacgcccagaagttccagggccgcgtcaccatcaccgccgaccagtccaccaacaccacctacatggaggtcaactccctccgctacgaggacaccgccgtctacttctgcgcccgcggccccaagtactactccgagtacatggacgtctggggcaagggcaccaccgtcaccgtctcctccggcaccggcggctccggcggcaccggctccggcaccggcggctccaccgacatccagatgacccagtccccctcctccctctccgcctccgtcggcgaccgcgtcaccatcacctgccgcgcctcccagggcatctcctcctacctcgcctggtaccagcagaagcccggcaaggtccccaccctcctcatctacgacgcctccaccctccgctccggcgtcccctcccgcttctccggctccggctccgccaccgacttcaccctcaccatctcctccctccagcccgaggacgtcgccacctactactgccagcgctacaactccgccccccccatcaccttcggccagggcacccgcctcgagatcaagcgc

SEQ ID NO: 20450 - RNA, 735 nt, synthetic construct
  misc_feature 1..735: note = derived and/or modified sequence opt2 from anti-influenza_Chain
  source 1..735: mol_type = other RNA
gaggtccagctcgtcgagtccggcgccgaggtcaagaagcccggctcctccgtcaaggtctcctgcaaggcctccggcggcaccttctcctcctacggcatctcctgggtccgccaggcccccggccagggcctcgagtggatgggcgacatcatcggcatgttcggctccaccaactacgcccagaacttccagggccgcctcaccatcaccgccgacgagtccacctccaccgcctacatggagctctcctccctccgctccgaggacaccgccgtctactactgcgcccgctcctccggctactaccccgcctacctcccccactggggccagggcaccctcgtcaccgtctcctccggcaccggcggctccggcggcaccggctccggcaccggcggctccaccgagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacggctcctccccccgcaccttcggcggcggcaccaaggtcgagatcaagcgc

SEQ ID NO: 20451 - RNA, 735 nt, synthetic construct
  misc_feature 1..735: note = derived and/or modified sequence opt2 from anti-influenza_Chain
  source 1..735: mol_type = other RNA
gaggtccagctcgtcgagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcatcggcatgttcggcaccgccaactacgcccagaagttccagggccgcgtcaccatcaccgccgacgagttcacctccaccgcctacatggagctctcctccctccgctccgaggacaccgccgtctactactgcgcccgcggcaactactactacgagtcctccctcgactactggggccagggcaccctcgtcaccgtctcctccggcaccggcggctccggcggcaccggctccggcaccggcggctccacccagtccgtcgtcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccactacgtcttcggcaccggcaccaaggtcaccgtcctcggc

SEQ ID NO: 20452 - RNA, 735 nt, synthetic construct
  misc_feature 1..735: note = derived and/or modified sequence opt2 from anti-influenza_Chain
  source 1..735: mol_type = other RNA
gaggtccagctcgtccagtccggcgccgaggtcaagaagcccggcgcctccgtcaaggtctcctgcaaggcctccggctacaccttcaccggctactacgtctactgggtccgccaggcccccggccagggcctcgagtggatgggctggatctccgcctacaacggcaacaccaactacgcccagaagttccagggccgcgtcaccatcaccgccgacaagtccacctccaccgcctacatggagctctcctccctccgctccgaggacaccgccgtctactactgcgcccgctcccgctccctcgacgtctggggccagggcaccaccgtcaccgtctcctccggcaccggcggctccggcggcaccggctccggcaccggcggctccaccgacgtcgtcatgacccagtcccccgactccctcgccgtctccctcggcgagcgcgccaccatcaactgcaagtcctcccagtccgtcctctactcctccaacaacaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagtactactccacccccctcaccttcggcggcggcaccaaggtcgacatcaagcgc

SEQ ID NO: 20453 - RNA, 735 nt, synthetic construct
  misc_feature 1..735: note = derived and/or modified sequence opt2 from anti-influenza_Chain
  source 1..735: mol_type = other RNA
gaggtccagctcgtcgagaccggcgccgaggtcaagaagcccggctcctccgtcaaggtcccctgcaagtcctccggctcccccttccgctccaacgccgtctcctgggtccgccaggcccccggccagggcctcgagtgggtcggcggcatcctcggcgtcttcggctccccctcctacgcccagaagttccagggccgcgtcaccatcaccgccgacgagtccaccaacaccgtccacatggagctccgcggcctccgctccgaggacaccgccgtctactactgcgcccgcggccccacctactactactcctacatggacgtctggggcaagggcaccaccgtcaccgtctcctccggcaccggcggctccggcggcaccggctccggcaccggcggctccacctcctacgtcctcacccagcccccctccgagtccgtcgcccccggccagaccgcccgcatcacctgcggcggcaacaacatcggccgcaactccgtccactggtaccagcagaagcccggccaggcccccgtcctcgtcgtctacgacgactccgaccgcccctccggcatccccgagcgcttctccggctccaagtccggcaacaccgccaccctcatcatctcccgcgtcgaggtcggcgacgaggccgactactactgccaggtctggcactcctcctccgaccactacgtcttcggcaccggcaccaaggtcaccgtcctcggc

SEQ ID NO: 20454 - RNA, 735 nt, synthetic construct
  misc_feature 1..735: note = derived and/or modified sequence opt2 from anti-influenza_Chain
  source 1..735: mol_type = other RNA
cagatgcagctcgtccagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcttcggcatgttcggcaccgccaactacgcccagaagttccagggccgcgtcaccatcaccgccgacgagttcacctccgccgcctacatggagctctcctccctcggctccgaggacaccgccatgtactactgcgcccgctcctccggctactacccccagtacttccaggactggggccagggcaccctcgtcaccgtctcctccggcaccggcggctccggcggcaccggctccggcaccggcggctccaccgagatcgtcatgacccagtcccccggcaccctctccctctcccccggccagcgcgccaccctctcctgccgcgcctcccagtccgtctcctcctcctacctcgcctggtaccagcagaagcccggccaggccccccgcctcctcatgtacggcgcctcctcccgcgccaccggcatccccgaccgcttctccggctccggctccggcaccgacttcaccctcaccatctcccgcctcgagcccgaggacttcgccgtctactactgccagcagtacggctcctcctccctcaccttcggcggcggcaccaagctcgagatcaagcgc

SEQ ID NO: 20455 - RNA, 735 nt, synthetic construct
  misc_feature 1..735: note = derived and/or modified sequence opt2 from anti-influenza_Chain
  source 1..735: mol_type = other RNA
caggtccagctcgtccagtccggcgccgaggtcaagaagcccggctcctccgtcaaggtctcctgcaaggcctccggcgtcaccttctcctactacgccatgtcctgggtccgccaggcccccggccagggcctcgagtggatgggcggcatctcccccatgttcggcaccaccacctacgcccagaagttccagggccgcgtcaccatcaccgccgacgactccacctccaccgcctacatggaggtccgctccctccgctccgaggacaccgccgtctactactgcgcccgctcctccaactactacgactccgtctacgactactggggccagggcaccctcgtcaccgtctcctccggcaccggcggctccggcggcaccggctccggcaccggcggctccacccagtccgtcgtcacccagcccccctccgagtccgtcgcccccggccagaccgcccgcatcacctgcggcggccacaacatcggctccaactccgtccactggtaccagcagaagcccggccaggcccccgtcctcgtcgtctacgacaactccgaccgcccctccggcatccccgagcgcttctccggctccaactccggcaacaccgccaccctcaccatctcccgcgtcgaggccggcgacgaggccgactactactgccaggtctggggctcctcctccgaccactacgtcttcggcaccggcaccaaggtcaccgtcctcggc

SEQ ID NO: 20456 - RNA, 738 nt, synthetic construct
  misc_feature 1..738: note = derived and/or modified sequence opt2 from anti-influenza_Chain
  source 1..738: mol_type = other RNA
caggtccagctcgtccagtccggcggcggcctcgtcaagcccggcggctccctccgcctctcctgcgccgcctccggcttcaccttctcctcctactccatgaactgggtccgccaggcccccggcaagggcctcgagtgggtctcctccatctcctcctcctcctcctacatctactacgtcgactccgtcaagggccgcttcaccatctcccgcgacaacgccaagaactccctctacctccagatgaactccctccgcgccgaggacaccgccgtctactactgcgcccgcggcggcggctcctacggcgcctacgagggcttcgactactggggccagggcaccctcgtcaccgtctcctccggcaccggcggctccggcggcaccggctccggcaccggcggctccaccgagatcgtcctcacccagtcccccggcaccctctccctctcccccggcgagcgcgccaccctctcctgccgcgcctcccagcgcgtctcctcctacctcgcctggtaccagcagaagcccggccaggccccccgcctcctcatctacggcgcctccacccgcgccgccggcatccccgaccgcttctccggctccggctccggcaccgacttcaccctcaccatctcccgcctcgagcccgaggactccgccgtctactactgccagcagtacggccgcacccccctcaccttcggcggcggcaccaaggtcgagatcaagcgc

SEQ ID NO: 20457 - RNA, 738 nt, synthetic construct
  misc_feature 1..738: note = derived and/or modified sequence opt2 from anti-influenza_Chain
  source 1..738: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccggcaccggcggctccggcggcaccggctccggcaccggcggctccacctcctacgtcctcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccacgccgtcttcggcggcggcacccagctcaccgtcctcggc

SEQ ID NO: 20458 - RNA, 738 nt, synthetic construct
  misc_feature 1..738: note = derived and/or modified sequence opt2 from anti-influenza_Chain
  source 1..738: mol_type = other RNA
gaggtccagctcgtcgagaccggcgccgaggtcaagaagcccggcgcctccgtcaaggtctcctgcaaggcctccggctacaccttcacctcctactacatgcactgggtccgccaggcccccggccagggcctcgagtggatgggctggatcaaccccaactccggcggcaccaactacgcccagaagttccagggccgcgtcaccatgacccgcgacacctccatctccaccgcctacatggagctctcccgcctccgctccgacgacaccgccgtctactactgcgcccgcgagggcaagtggggcccccaggccgccttcgacatctggggccagggcaccatggtcaccgtctcctccggcaccggcggctccggcggcaccggctccggcaccggcggctccaccgagatcgtcatgacccagtcccccggcaccctctccctctcccccggcgagcgcgccaccctctcctgccgcgcctcccagtccgtctcctcctcctacctcgcctggtaccagcagaagcccggccaggccccccgcctcctcatctacgacgcctcctcccgcgccaccgacatccccgaccgcttctccggctccggctccggcaccgacttcaccctcaccatctcccgcctcgagcccgaggacttcgccgtctactactgccagcagtacggctcctccctctggaccttcggccagggcaccaaggtcgagatcaagcgc

SEQ ID NO: 20459 - RNA, 738 nt, synthetic construct
  misc_feature 1..738: note = derived and/or modified sequence opt2 from anti-influenza_Chain
  source 1..738: mol_type = other RNA
gaggtccagctcgtcgagtccggcggcggcctcgtccagcccggcggctccctccgcctctcctgcgccgcctccggcttcaccttctccatctacgccatgtcctgggtccgccaggcccccggcaagggcctcgagtgggtctccgccatctcctcctccggcgactccacctactacgccgactccgtcaagggccgcttcaccatctcccgcgacaacgcccgcaacaccctctacctccagatgaactccctccgcgccgaggacaccgccgtctactactgcgcccgcgcctacggctacaccttcgacccctggggccagggcaccctcgtcaccgtctcctccggcaccggcggctccggcggcaccggctccggcaccggcggctccaccgagatcgtcctcacccagtcccccctctccctccccgtcacccccggcgagcccgcctccatctcctgccgctcctcccagtccctcctccactccaacggctacaactacctcgactggtacctccagaagcccggccagtccccccagctcctcatctacctcggctccaaccgcgcctccggcgtccccgaccgcttctccggctccggctccggcaccgacttcaccctcaagatctcccgcgtcgaggccgaggacgtcggcgtctactactgcatgcaggccctccagacccccctcaccttcggcggcggcaccaaggtcgagatcaagcgc

SEQ ID NO: 20460 - RNA, 738 nt, synthetic construct
  misc_feature 1..738: note = derived and/or modified sequence opt2 from anti-influenza_Chain
  source 1..738: mol_type = other RNA
gaggtccagctcgtcgagaccggcgccgaggtcaagaagcccggctcctccgtcaaggtctcctgcaaggcctccggcggcaccttccgcacccacgccatctcctgggtccgccaggcccccggccagggcctcgagtggatgggcggcatcatcgccatcttcggcaccgccaactacgcccagaagttccagggccgcatcaccatcaccgccgacgagtccacctccaccgcctacatggagctctcctccctccgctccgaggacaccgccgtctacttctgcgcccgcggctccggctaccacatctccacccccttcgacaactggggccagggcaccctcgtcaccgtctcctccggcaccggcggctccggcggcaccggctccggcaccggcggctccacctcctacgtcctcacccagcccccctccgtctccgtcgcccccggccagaccgcccgcatcacctgcggcggcaacaacatcggctccaagggcgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccacgtcgtcttcggcggcggcaccaagctcaccgtcctcggc

SEQ ID NO: 20461 - RNA, 738 nt, synthetic construct
  misc_feature 1..738: note = derived and/or modified sequence opt2 from anti-influenza_Chain
  source 1..738: mol_type = other RNA
gaggtccagctcgtccagtccggcgccgaggtcaagaagcccggctcctccgtcaaggtctcctgcaaggcctccggcggcatcttccgctccaactccatctcctgggtccgccaggcccccggccagggcctcgagtggatgggcggcatcttcgccctcttcggcaccaccgactacgcccagaagttccagggccgcgtcaccatcaccgccgacgagtcctccaccaccgtctacctcgagctctcctccctcacctccgaggacaccgccgtctactactgcgcccgcggctccggctacaccacccgcaactacttcgactactggggccagggcaccctcgtcaccgtctcctccggcaccggcggctccggcggcaccggctccggcaccggcggctccaccgagatcgtcctcacccagtcccccggcaccctctccctctcccccggcgagcgcgccaccctctcctgccgcgcctcccagtccgtctcctccaactacctcggctggtaccagcagaagcccggccaggccccccgcctcctcatctacggcgcctcctcccgcgcctccggcatccccgaccgcttctccggcggcggctccggcaccgacttcaccctcaccatctcccgcctcgagcccgaggacttcgccgtctactactgccagcagtacggctcctcccccctcaccttcggcggcggcaccaaggtcgagatcaagcgc

SEQ ID NO: 20462 - RNA, 738 nt, synthetic construct
  misc_feature 1..738: note = derived and/or modified sequence opt2 from anti-influenza_Chain
  source 1..738: mol_type = other RNA
gaggtccagctcgtcgagtccggcgccgaggtcaagaagcccggctcctccgtcaaggtctcctgcaaggcctccggcggcatcttcaactcctacgccatctcctgggtccgccaggcccccggccagggcctcgagtggatgggcggcatcatcgccatcttccacacccccaagtacgcccagaagttccagggccgcgtcaccatcaccgccgacgagtccaccaacaccgcctacatggagctccgctccctcaagtccgaggacaccgccctctactactgcgcccgcggctccacctacgacttctcctccggcctcgactactggggccagggcaccctcgtcaccgtctcctccggcaccggcggctccggcggcaccggctccggcaccggcggctccacccaggccggcctcacccagcccccctccgtctccgtcgcccccggccagaccgcccgcatcacctgcggcggcaacaacatcggctccaagtccgtccactggtaccagcagaagcccggccaggcccccgtcctcgtcgtctacgacgactccgaccgcccctccggcatccccgagcgcttctccggctccaactccggcaacaccgccaccctcaccatctcccgcgtcgaggccggcgacgaggccgactactactgccaggtctgggactcctcctccgaccacgtcgtcttcggcggcggcaccaagctcaccgtcctcggc

SEQ ID NO: 20463 - RNA, 741 nt, synthetic construct
  misc_feature 1..741: note = derived and/or modified sequence opt2 from anti-influenza_Chain
  source 1..741: mol_type = other RNA
cagatgcagctcgtccagtccggcgccgaggtcaagaagcccggctcctccgtcaaggtctcctgcaaggcctccggcggcaccttctcctcctacgccatcacctgggtccgccaggcccccggccagggcctcgagtggatgggcggcatcatcggcatgttcggctccaccaactacgcccagaacttccagggccgcgtcaccatcaccgccgacgagtccacctccaccgcctacatggagctctcctccctccgctccgaggacaccgccgtctactactgcgcccgctccaccggctactaccccgcctacctccaccactggggccagggcaccctcgtcaccgtctcctccggcaccggcggctccggcggcaccggctccggcaccggcggctccacccagtccgccctcacccagccccgctccgtctccggctcccccggccagtccgtcaccatctcctgcaccggcacctcctccgacgtcggcggctacaactacgtctcctggtaccagcagcaccccggcaaggcccccaagctcatgatctacgacgtctccaagcgcccctccggcgtccccgaccgcttctccggctccaagtccggcaacaccgcctccctcaccatctccggcctccaggccgaggacgaggccgactactactgctcctcctacacctcctcctccacccacgtcttcggcaccggcaccaaggtcaccgtcctcggc

SEQ ID NO: 20464 - RNA, 744 nt, synthetic construct
  misc_feature 1..744: note = derived and/or modified sequence opt2 from anti-influenza_Chain
  source 1..744: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccggcaccggcggctccggcggcaccggctccggcaccggcggctccacctcctacgtcctcacccagcccccctccgcctccggcacccccggccagcgcgtcaccatctcctgctccggctccaccttcaacatcggctccaacgccgtcgactggtaccgccagctccccggcaccgcccccaagctcctcatctactccaacaaccagcgcccctccggcgtccccgaccgcttctccggctcccgctccggcacctccgcctccctcgccatctccggcctccagtccgaggacgaggccgactactactgcgccgcctgggacgacatcctcaacgtccccgtcttcggcggcggcaccaagctcaccgtcctcggc

SEQ ID NO: 20465 - RNA, 744 nt, synthetic construct
  misc_feature 1..744: note = derived and/or modified sequence opt2 from anti-influenza_Chain
  source 1..744: mol_type = other RNA
caggtccagctcgtccagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccggcaccggcggctccggcggcaccggctccggcaccggcggctccacccagtccgccctcacccagcccgccgccgtctccggctcccccggccagtccatcaccatctcctgcaccggcacctcctccgacgtcggcggctacaactacgtctcctggtaccagcagcaccccggcaaggcccccaagctcatgatctacgaggtctccaaccgcccctccggcgtctccaaccgcttctccggctccaagtccggcaacaccgcctccctcaccatctccggcctccaggccgaggacgaggccgactactactgctcctcctacacctcctcctccacctacgtcttcggcaccggcaccaaggtcaccgtcctcggc

SEQ ID NO: 20466 - RNA, 744 nt, synthetic construct
  misc_feature 1..744: note = derived and/or modified sequence opt2 from anti-influenza_Chain
  source 1..744: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccggcaccggcggctccggcggcaccggctccggcaccggcggctccacctcctacgtcctcacccagcccccctccgtctccggcacccccggccagcgcgtcaccatctcctgctccggctcccgctccaacgtcggcgacaactccgtctactggtaccagcacgtccccgagatggcccccaagctcctcgtctacaagaacacccagcgcccctccggcgtccccgcccgcttctccggctccaagtccggcacctccgcctccctcgccatcatcggcctccagtccggcgacgaggccgactactactgcgtcgcctgggacgactccgtcgacggctacgtcttcggctccggcaccaaggtcaccgtcctcggc

SEQ ID NO: 20467 - RNA, 744 nt, synthetic construct
  misc_feature 1..744: note = derived and/or modified sequence opt2 from anti-influenza_Chain
  source 1..744: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccggcaccggcggctccggcggcaccggctccggcaccggcggctccacctcctacgtcctcacccagcccccctccgcctccggcacccccggccagcgcgtcaccatctcctgctccggctcctcctccaacatcggctccaactacgtctactggtaccagcagctccccggcaccgcccccaagctcctcatctaccgcgacggccagcgcccctccggcgtccccgaccgcttctccggctccaagtccggcacctccgcctccctcgccatctccggcctccgctccgacgacgaggccgactactactgcgccacctgggacgacaacctctccggccccgtcttcggcggcggcaccaagctcaccgtcctcggc

SEQ ID NO: 20468 - RNA, 744 nt, synthetic construct
  misc_feature 1..744: note = derived and/or modified sequence opt2 from anti-influenza_Chain
  source 1..744: mol_type = other RNA
gaggtccagctcgtcgagtccggcgccgaggtcaagaagcccggctcctccgtcaaggtctcctgcaaggcctccggcggcaccttctccttctactccatgtcctgggtccgccaggcccccggccagggcctcgagtggatgggcggcatcatccccatgttcggcaccaccaactacgcccagaagttccagggccgcgtcaccatcaccgccgtcgagtccacctccaccgcctacatggaggtctcctccctccgctccgaggacaccgccgtctactactgcgcccgcggcgacaagggcatctactactactacatggacgtctggggcaagggcaccaccgtcaccgtctcctccggcaccggcggctccggcggcaccggctccggcaccggcggctccacccagtccgccctcacccagcccgcctccgtctccggctcccccggccagtccatcaccatctcctgcaccggcacctcctccgacgtcggcggctacaactacgtctcctggtaccagcagcaccccggcaaggcccccaagctcatgatctacgaggtctccaaccgcccctccggcgtctccaaccgcttctccggctccaagtccggcaacaccgcctccctcaccatctccggcctccaggccgaggacgaggccgactactactgctcctcctacacctcctcctccaccctcgtcttcggcaccggcaccaaggtcaccgtcctcggc

SEQ ID NO: 20469 - RNA, 744 nt, synthetic construct
  misc_feature 1..744: note = derived and/or modified sequence opt2 from anti-influenza_Chain
  source 1..744: mol_type = other RNA
atgtccctcttcggcgacaccatcgcctacctcctctccctcatcgaggacggcgagggcaaggccgagctcgccgagaagctccactgctggttcggcggcaaggagttcgacctcgactccgccctcgagtggatcaagaacaagcgctgcctcaccgacatccagaaggccctcatcggcgcctccatctgcttcctcaagcccaaggaccaggagcgcaagcgccgcttcatcaccgagcccctctccggcatgggcaccaccgccaccaagaagaagggcctcatcctcgccgagcgcaagatgcgccgctgcgtctccttccacgaggccttcgagatcgccgagggccacgagtcctccgccctcctctactgcctcatggtcatgtacctcaaccccgagaactactccatgcaggtcaagctcggcaccctctgcgccctctgcgagaagcaggcctcccactcccaccgcgcccactcccgcgccgcccgctcctccgtccccggcgtccgccgcgagatgcagatggtctccgccatgaacaccgccaagaccatgaacggcatgggcaagggcgaggacgtccagaagctcgccgaggagctccagaacaacatcggcgtcctccgctccctcggcgcctcccagaagaacggcgagggcatcgccaaggacgtcatggaggtcctcaagcagtcctccatgggcaactccgccctcgtccgcaagtacctc

SEQ ID NO: 20470 - RNA, 747 nt, synthetic construct
  misc_feature 1..747: note = derived and/or modified sequence opt2 from anti-influenza_Chain
  source 1..747: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccggcaccggcggctccggcggcaccggctccggcaccggcggctccacccagtccgtcctcacccagcccccctccgtctccgccgcccccggccagaaggtcaccatctcctgctccggctcctcctccaacatcggcaacgactacgtctcctggtaccagcagctccccggcaccgcccccaagctcctcatctacgacaacaacaagcgcccctccggcatccccgaccgcttctccggctccaagtccggcacctccgccaccctcggcatcaccggcctccagaccggcgacgaggccaactactactgcgccacctgggaccgccgccccaccgcctacgtcgtcttcggcggcggcaccaagctcaccgtcctcggc

SEQ ID NO: 20471 - RNA, 750 nt, synthetic construct
  misc_feature 1..750: note = derived and/or modified sequence opt2 from anti-influenza_Chain
  source 1..750: mol_type = other RNA
caggtccagctcgtccagtccggcgccgaggtcaagaagcccggctcctccgtccgcgtctcctgcaaggcctccggctccatcttccgcaactacgccatgtcctgggtccgccaggcccccggccagggcctcgagtggatgggcggcatcatcgccatcttcggcacccccaagtacgcccagaagttccagggccgcgtcaccatcaccgccgacgagtccacctccaccgtctacatggagctctccggcctccgctccgaggacaccgccatgtactactgcgcccgcatcccccactacaacttcggctccggctcctacttcgactactggggccagggcaccctcgtcaccgtctcctccggcaccggcggctccggcggcaccggctccggcaccggcggctccaccaccgtcctcacccagcccccctccgtctccggcgcccccggccagcgcgtcaccatctcctgcaccggctcctcctccaacatcggcgccggctacgacgtccactggtaccagcagctccccggcaccgcccccaagctcctcatctacggcaactccaaccgcccctccggcgtccccgaccgcttctccggctccaagtccggcacctccgccaccctcggcatcaccggcctccagaccggcgacgaggccgactactactgcggcacctgggactcctccctctccgcctacgtcttcggcaccggcaccaaggtcaccgtcctcggc

SEQ ID NO: 20472 - RNA, 756 nt, synthetic construct
  misc_feature 1..756: note = derived and/or modified sequence opt2 from anti-influenza_Chain
  source 1..756: mol_type = other RNA
gaggtccagctcgtcgagtccggcgccgaggtcaagaagcccggctcctccgtcaaggtctcctgcaaggcctccggccacatcttctccggctacgccatctcctgggtccgccaggcccccggccagggcctcgagtggatgggcggcatcatccccatcttcggcaccaccaactacgcccagaagttccagggccgcgtcaccatcaccgccgaccagtccacctccaccgcctacatggacctctccaacctccgctccgaggacaccgccgtctactactgcgcccgcgtcaaggacggctactgcaccctcacctcctgccccgtcggctggtacttcgacctctggggccgcggcaccctcgtcaccgtctcctccggcaccggcggctccggcggcaccggctccggcaccggcggctccaccgagatcgtcatgacccagtcccccggcaccctctccctctcccccggcgagcgcgccaccctctcctgccgcgcctcccagtccgtctcctcctcctacctcgcctggtaccagcagaagcccggccaggccccccgcctcctcatcttcggcgcctcctcccgcgccaccggcatccccgaccgcttctccggctccggctccggcaccgacttcaccctcaccatctcccgcctcgagcccgaggacttcgccgtctactactgccagcagtacggctcctccctcaccttcggcggcggcaccaagctcgagatcaagcgc

SEQ ID NO: 20473 - RNA, 768 nt, synthetic construct
  misc_feature 1..768: note = derived and/or modified sequence opt2 from anti-influenza_Chain
  source 1..768: mol_type = other RNA
caggtccagctcgtccagtccggcgccgaggtcaagaagcccggctcctccgtcaaggtctcctgcaaggcctccggcggcttcttctcctcctacgccatctcctgggtccgccaggcccccggccagggcctcgagtggatgggcggcgtcatccccatcttccgcaccgccaactacgcccagaacttccagggccgcgtcaccatcaccgccgacgagttcacctcctacatggagctctcctccctccgctccgacgacaccgccgtctactactgcgcccgcctcaactaccacgactccggcacctactacaacgccccccgcggctggttcgacccctggggccagggcaccctcgtcaccgtctcctccggcaccggcggctccggcggcaccggctccggcaccggcggctccaccgacatccagatgacccagtcccccgactccctcgccgtctccctcggcgagaaggccaccatcaactgcaagtcctcccagtccatcctcaactcctccaacaacaagaactacctcgcctggtaccagcagaagcccggccagccccccaagctcctcatctactgggcctccacccgcgagtccggcgtccccgaccgcttctccggctccggctccggcaccgacttcaccctcaccatctcctccctccaggccgaggacgtcgccgtctactactgccagcagtactactcctccccccccaccttcggccagggcaccaaggtcgagatcaagcgc

SEQ ID NO: 20474 - RNA, 768 nt, synthetic construct; identical to SEQ ID NO: 20473
  misc_feature 1..768: note = derived and/or modified sequence opt2 from anti-influenza_Chain
  source 1..768: mol_type = other RNA

SEQ ID NO: 20475 - RNA, 771 nt, synthetic construct
  misc_feature 1..771: note = derived and/or modified sequence opt2 from anti-influenza_Chain
  source 1..771: mol_type = other RNA
atctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaag

SEQ ID NO: 20476 - RNA, 771 nt, synthetic construct; identical to SEQ ID NO: 20475
  misc_feature 1..771: note = derived and/or modified sequence opt2 from anti-influenza_Chain
  source 1..771: mol_type = other RNA

SEQ ID NO: 20477 - RNA, 777 nt, synthetic construct
  misc_feature 1..777: note = derived and/or modified sequence opt2 from anti-influenza_Chain
  source 1..777: mol_type = other RNA
atggtcaagtccaagtacctcgtcttcatctccgtcttctccctcctcttcggcgtcttcgtcgtcggcttctcccaccagggcgtcaaggccgaggaggagcgccccatgggcaccgccttctacgagtccttcgacgccttcgacgacgagcgctggtccaaggccggcgtctggaccaacggccagatgttcaacgccacctggtaccccgagcaggtcaccgccgacggcctcatgcgcctcaccatcgccaagaagaccacctccgcccgcaactacaaggccggcgagctccgcaccaacgacttctaccactacggcctcttcgaggtctccatgaagcccgccaaggtcgagggcaccgtctcctccttcttcacctacaccggcgagtgggactgggacggcgacccctgggacgagatcgacatcgagttcctcggcaaggacaccacccgcatccagttcaactacttcaccaacggcgtcggcggcaacgagttctactacgacctcggcttcgacgcctccgagtccttcaacacctacgccttcgagtggcgcgaggactccatcacctggtacgtcaacggcgaggccgtccacaccgccaccgagaacatcccccagaccccccagaagatcatgatgaacctctggcccggcgtcggcgtcgacggctggaccggcgtcttcgacggcgacaacacccccgtctactcctactacgactgggtccgctacacccccctccagaactaccagatccaccag

SEQ ID NO: 20478 - RNA, 777 nt, synthetic construct; identical to SEQ ID NO: 20477
  misc_feature 1..777: note = derived and/or modified sequence opt2 from anti-influenza_Chain
  source 1..777: mol_type = other RNA

SEQ ID NO: 20479 - RNA, 783 nt, synthetic construct
  misc_feature 1..783: note = derived and/or modified sequence opt2 from anti-influenza_Chain
  source 1..783: mol_type = other RNA
gacatccagatgacccagtccccctcctccgtctccgcctccgtcggcgaccgcgtcaccatcacctgccgcgcctcccaggacatctccacctggctcgcctggtaccagcagaagcccggcaaggcccccaagctcctcatctacgccgcctcctccctccagtccggcgtcccctcccgcttctccggctccggctccggcaccgacttcaccctcaccatctcctccctccagcccgaggacttcgccacctacttctgccagcaggccaactccttcccccccaccttcggctgcggcaccaagctcgagatcaagggcggcggcggctccggcggcggcggctccggcggcggcggctccggcggcggcggctccgaggtccagctcgtcgtctccggcggcggcctcgtcaagcccggcggctccctccgcctctcctgcgccgcctccggcctctccttcctcaacgcctggatgtcctgggtccgccaggcccccggcaagtgcctcgagtgggtcggccgcatcaagtccaacaccgacggcggcaccaccgactacgccgcccccgtcaagggccgcttctccatctcccgcgacgactccaagaacatgctcttcctccacatgtcctccctccgcaccgaggacaccgccgtctactactgcgccaccgacggcccctactccgacgacttccgctccggctacgccgcccgctaccgctacttcggcatggacgtctggggccagggcaccaccgtcaccgtctcctcc

SEQ ID NO: 20480 - RNA, 783 nt, synthetic construct; identical to SEQ ID NO: 20479
  misc_feature 1..783: note = derived and/or modified sequence opt2 from anti-influenza_Chain
  source 1..783: mol_type = other RNA

SEQ ID NO: 20481 - RNA, 789 nt, synthetic construct
  misc_feature 1..789: note = derived and/or modified sequence opt2 from anti-influenza_Chain
  source 1..789: mol_type = other RNA
atgggcttcgtcctcttctcccagctcccctccttcctcctcgtctccaccctcctcctcttcctcgtcatctcccactcctgccgcgcccagaacggcggctcctacccctacaagtccggcgagtaccgcaccaagtccttcttcggctacggctactacgaggtccgcatgaaggccgccaagaacgtcggcatcgtctcctccttcttcacctacaccggcccctccgacaacaacccctgggacgagatcgacatcgagttcctcggcaaggacaccaccaaggtccagttcaactggtacaagaacggcgtcggcggcaacgagtacctccacaacctcggcttcgacgcctcccaggacttccacacctacggcttcgagtggcgccccgactacatcgacttctacgtcgacggcaagaaggtctaccgcggcacccgcaacatccccgtcacccccggcaagatcatgatgaacctctggcccggcatcggcgtcgacgagtggctcggccgctacgacggccgcacccccctccaggccgagtacgagtacgtcaagtactaccccaacggccgctccaagctcgtcgtcaacacccccttcgtcgccgtcttctccaacttcgactcctcccagtgggagaaggccgactgggccaacggctccgtcttcaactgcgtctggaagccctcccaggtcaccttctccaacggcaagatgatcctcaccctcgaccgcgagtacgtcgaccaccaccaccaccaccacaaggacgagctc

SEQ ID NO: 20482 - RNA, 789 nt, synthetic construct; identical to SEQ ID NO: 20481
  misc_feature 1..789: note = derived and/or modified sequence opt2 from anti-influenza_Chain
  source 1..789: mol_type = other RNA

SEQ ID NO: 20483 - RNA, 840 nt, synthetic construct
  misc_feature 1..840: note = derived and/or modified sequence opt2 from anti-influenza_Chain
  source 1..840: mol_type = other RNA
atggcccaggtcggccgcggcgcctcccccctctcccgcgcccgcgtcccccccctcccccaccccctcgacggcgagcacctcccccacgaccccgccggcggcggccacggcaaggcctcctcccaggacgcccccgtcggccagctccccggccacctcgcccgccccgccttcttccactacctcaagaactccttcctcgtctgctccctcaccaccgtcttcgccctcgccgtcgccaccttcgccggctacgccctcgcccgcttccgcttccccggcgccgagctcttcggcggctccgtcctcgtcacccaggtcatccccggcatcctcttcctcatccccatctacatcatgtacatctacgtccagaactgggtccgctccgccctcggcctcgaggtccgcctcgtcggctcctacggcggcctcgtcttcacctacaccgccttcttcgtccccctctccatctggatcctccgcggcttcttcgcctccatccccaaggagctcgaggaggccgccatggtcgacggcgccacccccttccaggccttccaccgcgtcatcctccccctcgccctccccggcctcgccgccaccgccgtctacatcttcctcaccgcctgggacgagctcctcttcgcccaggtcctcaccaccgaggccaccgccaccgtccccgtcggcatccgcaacttcgtcggcaactaccagaaccgctacgacctcgtcatggccgccgccaccgtcgccaccctccccgtcctcgtcctcttcttcttcgtccagcgccagctcatccagggcctcaccgccggcgccgtcaagggc

SEQ ID NO: 20484 - RNA, 840 nt, synthetic construct; identical to SEQ ID NO: 20483
  misc_feature 1..840: note = derived and/or modified sequence opt2 from anti-influenza_Chain
  source 1..840: mol_type = other RNA

SEQ ID NO: 20485 - RNA, 843 nt, synthetic construct
  misc_feature 1..843: note = derived and/or modified sequence opt2 from anti-influenza_Chain
  source 1..843: mol_type = other RNA
atggccgacaacatgaccaccacccagatcgaggtcggccccggcgccaccaacgccaccatcaacttcgaggccggcatcctcgagtgctacgagcgcttctcctggcagcgcgccctcgactaccccggccaggaccgcctccaccgcctcaagcgcaagctcgagtcccgcatcaagacccacaacaagtccgagcccgagaacaagcgcatgtccctcgaggagcgcaaggccatcggcgtcaagatgatgaaggtcctcctcttcatggacccctccgccggcatcgagggcttcgagccctactgcgtcaagaacccctccacctccaagtgccccaactacgactggaccgactacccccccacccccggcaagtacctcgacgacatcgaggaggagcccgagaacgtcgaccaccccatcgaggtcgtcctccgcgacatgaacaacaaggacgcccgccagaagatcaaggacgaggtcaacacccagaaggagggcaagttccgcctcaccatcaagcgcgacatccgcaacgtcctctccctccgcgtcctcgtcaacggcaccttcctcaagcaccccaacggcgacaagtccctctccaccctccaccgcctcaacgcctacgaccagaacggcggcctcgtcgccaagctcgtcgccaccgacgaccgcaccgtcgaggacgagaaggacggccaccgcatcctcaactccctcttcgagcgcttcgacgagggccactccaagcccatccgcgccgccgagaccgccgtcggcgtcctctcccagttcggccaggagcaccgcctctcccccgaggagggcgacaac

SEQ ID NO: 20486 - RNA, 843 nt, synthetic construct; identical to SEQ ID NO: 20485
  misc_feature 1..843: note = derived and/or modified sequence opt2 from anti-influenza_Chain
  source 1..843: mol_type = other RNA

SEQ ID NO: 20487 - RNA, 858 nt, synthetic construct
  misc_feature 1..858: note = derived and/or modified sequence opt2 from anti-influenza_Chain
  source 1..858: mol_type = other RNA
atgtgcaccatgcccctcatgaagctcaagaagatgatgcgccgcaccgccttcctcctctccgtcctcatcggctgctccatgctcggctccgaccgctccgacaaggccccccactgggagctcgtctggtccgacgagttcgactactccggcctccccgaccccgagaagtgggactacgacgtcggcggccacggctggggcaaccaggagctccagtactacacccgcgcccgcatcgagaacgcccgcgtcggcggcggcgtcctcatcatcgaggcccgccacgagccctacgagggccgcgagtacacctccgcccgcctcgtcacccgcggcaaggcctcctggacctacggccgcttcgagatccgcgcccgcctcccctccggccgcggcacctggcccgccatctggatgctccccgaccgccagacctacggctccgcctactggcccgacaacggcgagatcgacatcatggagcacgtcggcttcaaccccgacgtcgtccacggcaccgtccacaccaaggcctacaaccacctcctcggcacccagcgcggcggctccatccgcgtccccaccgcccgcaccgacttccacgtctacgccatcgagtggacccccgaggagatccgctggttcgtcgacgactccctctactaccgcttccccaacgagcgcctcaccgaccccgaggccgactggcgccactggcccttcgaccagcccttccacctcatcatgaacatcgccgtcggcggcgcctggggcggccagcagggcgtcgaccccgaggccttccccgcccagctcgtcgtcgactacgtccgcgtctaccgctgggtcgag

SEQ ID NO: 20488 - RNA, 858 nt, synthetic construct; identical to SEQ ID NO: 20487
  misc_feature 1..858: note = derived and/or modified sequence opt2 from anti-influenza_Chain
  source 1..858: mol_type = other RNA

SEQ ID NO: 20489 - RNA, 900 nt, synthetic construct
  misc_feature 1..900: note = derived and/or modified sequence opt2 from anti-influenza_Chain
  source 1..900: mol_type = other RNA
aacgtccccgagtggtcctacatcgtcgagaaggccaaccccgccaacgacctctgctaccccggcaacttcaacgactacgaggagctcaagcacctcctctcccgcatcaaccacttcgagaagatccagggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20490 - RNA, 900 nt, synthetic construct; identical to SEQ ID NO: 20489
  misc_feature 1..900: note = derived and/or modified sequence opt2 from anti-influenza_Chain
  source 1..900: mol_type = other RNA

SEQ ID NO: 20491 - RNA, 927 nt, synthetic construct
  misc_feature 1..927: note = derived and/or modified sequence opt2 from anti-influenza_Chain
  source 1..927: mol_type = other RNA
atggtcaaccgccgcgacctcatcaagtggtccgccgtcgccctcggcgccggcgccggcctcgccggccccgcccccgccgcccacgccgccgacctcgagtgggagcagtaccccgtccccgccgcccccggcggcaaccgctcctggcagctcctcccctcccactccgacgacttcaactacaccggcaagccccagaccttccgcggccgctggctcgaccagcacaaggacggctggtccggccccgccaactccctctactccgcccgccactcctgggtcgccgacggcaacctcatcgtcgagggccgccgcgcccccgacggccgcgtctactgcggctacgtcacctcccgcacccccgtcgagtaccccctctacaccgaggtcctcatgcgcgtctccggcctcaagctctcctccaacttctggctcctctcccgcgacgacgtcaacgagatcgacgtcatcgagtgctacggcaacgagtccctccacggcaagcacatgaacaccgcctaccacatcttccagcgcaaccccttcaccgagctcgcccgctcccagaagggctacttcgccgacggctcctacggctacaacggcgagaccggccaggtcttcggcgacggcgccggccagcccctcctccgcaacggcttccaccgctacggcgtccactggatctccgccaccgagttcgacttctacttcaacggccgcctcgtccgccgcctcaaccgctccaacgacctccgcgacccccgctcccgcttcttcgaccagcccatgcacctcatcctcaacaccgagtcccaccagtggcgcgtcgaccgcggcatcgagcccaccgacgccgagctcgccgacccctccatcaacaacatctactaccgctgggtccgcacctaccaggccgtc

SEQ ID NO: 20492 - RNA, 927 nt, synthetic construct; identical to SEQ ID NO: 20491
  misc_feature 1..927: note = derived and/or modified sequence opt2 from anti-influenza_Chain
  source 1..927: mol_type = other RNA

SEQ ID NO: 20493 - RNA, 960 nt, synthetic construct
  misc_feature 1..960: note = derived and/or modified sequence opt2 from anti-influenza_Chain
  source 1..960: mol_type = other RNA
atctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctc

SEQ ID NO: 20494 - RNA, 960 nt, synthetic construct; identical to SEQ ID NO: 20493
  misc_feature 1..960: note = derived and/or modified sequence opt2 from anti-influenza_Chain
  source 1..960: mol_type = other RNA

SEQ ID NO: 20495 - RNA, 960 nt, synthetic construct; identical to SEQ ID NO: 20493
  misc_feature 1..960: note = derived and/or modified sequence opt2 from anti-influenza_Chain
  source 1..960: mol_type = other RNA

SEQ ID NO: 20496 - RNA, 978 nt, synthetic construct
  misc_feature 1..978: note = derived and/or modified sequence opt2 from anti-influenza_Chain
  source 1..978: mol_type = other RNA
accctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacgcctacgtcttcgtcggcacctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcgacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgc

SEQ ID NO: 20497 - RNA, 978 nt, synthetic construct; identical to SEQ ID NO: 20496
  misc_feature 1..978: note = derived and/or modified sequence opt2 from anti-influenza_Chain
  source 1..978: mol_type = other RNA

SEQ ID NO: 20498 - RNA, 960 nt, synthetic construct; identical to SEQ ID NO: 20493
  misc_feature 1..960: note = derived and/or modified sequence opt2 from anti-influenza_Chain
  source 1..960: mol_type = other RNA

SEQ ID NO: 20499 - RNA, 990 nt, synthetic construct
  misc_feature 1..990: note = derived and/or modified sequence opt2 from anti-influenza_Chain
  source 1..990: mol_type = other RNA
atgtgctcctccatcccctccctccgcgaggtcttcgccaacgacttccgcatcggcgccgccgtcaaccccgtcaccctcgaggcccagcagtccctcctcatccgccacgtcaactccctcaccgccgagaaccacatgaagttcgagcacctccagcccgaggagggccgcttcaccttcgacatcgccatcaagtcctccacctcccccttctcctcccacggcgtccgcggccacaccctcgtctggcacaaccagaccccctcctgggtcttccaggactcccagggccacttcgtcggccgcgacgtcctcctcgagcgcatgaagtcccacatctccaccgtcgtccagcgctacaagggcaaggtctactgctgggacgtcatcaacgaggccgtcgccgacgagggctccgagtggctccgctcctccacctggcgccagatcatcggcgacgacttcatccagcaggccttcctctacgcccacgaggccgaccccgaggccctcctcttctacaacgactacaacgagtgcttccccgagaagcgcgagaagatctacaccctcgtcaagtccctccgcgacaagggcatccccatccacggcatcggcatgcaggcccactggtccctcaaccgccccaccctcgacgagatccgcgccgccatcgagcgctacgcctccctcggcgtcatcctccacatcaccgagctcgacatctccatgttcgagttcgacgaccaccgcaaggacctcgccgcccccaccaacgagatggtcgagcgccaggccgagcgctacgagcagatcttctccctcttcaaggagtaccgcgacgtcatccagaacgtcaccttctggggcatcgccgacgaccacacctggctcgaccacttccccgtccagggccgcaagaactggcccctcctcttcgacgagcagcacaaccccaagcccgccttctggcgcgtcgtcaacatc

SEQ ID NO: 20500 - RNA, 990 nt, synthetic construct; identical to SEQ ID NO: 20499
  misc_feature 1..990: note = derived and/or modified sequence opt2 from anti-influenza_Chain
  source 1..990: mol_type = other RNA

SEQ ID NO: 20501 - RNA, 1002 nt, synthetic construct
  misc_feature 1..1002: note = derived and/or modified sequence opt2 from anti-influenza_Chain
  source 1..1002: mol_type = other RNA
atgaagaaccgcgtcatctccctcctcatggcctccctcctcctcgtcctctccgtcatcgtcgcccccttctacaaggccgaggccgccaccgtcgtcaacacccccttcgtcgccgtcttctccaacttcgactcctcccagtgggagaaggccgactgggccaacggctccgtcttcaactgcgtctggaagccctcccaggtcaccttctccaacggcaagatgatcctcaccctcgaccgcgagtacggcggctcctacccctacaagtccggcgagtaccgcaccaagtccttcttcggctacggctactacgaggtccgcatgaaggccgccaagaacgtcggcatcgtctcctccttcttcacctacaccggcccctccgacaacaacccctgggacgagatcgacatcgagttcctcggcaaggacaccaccaaggtccagttcaactggtacaagaacggcgtcggcggcaacgagtacctccacaacctcggcttcgacgcctcccaggacttccacacctacggcttcgagtggcgccccgactacatcgacttctacgtcgacggcaagaaggtctaccgcggcacccgcaacatccccgtcacccccggcaagatcatgatgaacctctggcccggcatcggcgtcgacgagtggctcggccgctacgacggccgcacccccctccaggccgagtacgagtacgtcaagtactaccccaacggcgtcccccaggacaaccccacccccacccccaccatcgccccctccacccccaccaaccccaacctccccctcaagggcgacgtcaacggcgacggccacgtcaactcctccgactactccctcttcaagcgctacctcctccgcgtcatcgaccgcttccccgtcggcgaccagtccgtcgccgacgtcaaccgcgacggccgcatcgactccaccgacctcaccatgctcaagcgctacctcatccgcgccatcccctccctc

SEQ ID NO: 20502 - RNA, 1002 nt, synthetic construct; identical to SEQ ID NO: 20501
  misc_feature 1..1002: note = derived and/or modified sequence opt2 from anti-influenza_Chain
  source 1..1002: mol_type = other RNA

SEQ ID NO: 20503 - RNA, 1041 nt, synthetic construct
  misc_feature 1..1041: note = derived and/or modified sequence opt2 from anti-influenza_Chain
  source 1..1041: mol_type = other RNA
atctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctcggctacatccccgaggccccccgcgacggccaggcctacgtccgcaaggacggcgagtgggtcctcctctccaccttcctc

SEQ ID NO: 20504 - RNA, 1041 nt, synthetic construct; identical to SEQ ID NO: 20503
  misc_feature 1..1041: note = derived and/or modified sequence opt2 from anti-influenza_Chain
  source 1..1041: mol_type = other RNA

SEQ ID NO: 20505 - RNA, 1047 nt, synthetic construct
  misc_feature 1..1047: note = derived and/or modified sequence opt2 from anti-influenza_Chain
  source 1..1047: mol_type = other RNA
atgaacatcaagaagaccgccgtcaagtccgccctcgccgtcgccgccgccgccgccgccctcaccaccaacgtctccgccaaggacttctccggcgccgagctctacaccctcgaggaggtccagtacggcaagttcgaggcccgcatgaagatggccgccgcctccggcaccgtctcctccatgttcctctaccagaacggctccgagatcgccgacggccgcccctgggtcgaggtcgacatcgaggtcctcggcaagaaccccggctccttccagtccaacatcatcaccggcaaggccggcgcccagaagacctccgagaagcaccacgccgtctcccccgccgccgaccaggccttccacacctacggcctcgagtggacccccaactacgtccgctggaccgtcgacggccaggaggtccgcaagaccgagggcggccaggtctccaacctcaccggcacccagggcctccgcttcaacctctggtcctccgagtccgccgcctgggtcggccagttcgacgagtccaagctccccctcttccagttcatcaactgggtcaaggtctacaagtacacccccggccagggcgagggcggctccgacttcaccctcgactggaccgacaacttcgacaccttcgacggctcccgctggggcaagggcgactggaccttcgacggcaaccgcgtcgacctcaccgacaagaacatctactcccgcgacggcatgctcatcctcgccctcacccgcaagggccaggagtccttcaacggccaggtcccccgcgacgacgagcccgccccccagtcctcctcctccgcccccgcctcctcctcctccgtccccgcctcctcctcctccgtccccgcctcctcctcctccgccttcgtccccccctcctcctcctccgccaccaacgccatccacggcatgcgcaccacccccgccgtcgccaaggagcaccgcaacctcgtcaacgccaagggcgccaaggtcaaccccaacggccacaagcgctaccgcgtcaacttcgagcac

SEQ ID NO: 20506 - RNA, 1047 nt, synthetic construct
  misc_feature 1..1047: note = derived and/or modified sequence opt2 from anti-influenza_Chain
  source 1..1047: mol_type = other RNA
gaggtccagctcgtcgagtccggcggcggcgtcgtccagcccggccgctccctccgcctctcctgcgccgcctccggcttcgccttccacaaccgcgccatgcactgggtccgccaggcccccggcaagggcctcgagtgggtcgccctcatctacttcgacggctccaagcagtactacgccgactccgtcaagggccgcttcaccatctcccgcgacaactccaagaacaccgtcttcctccagatgaactccctccgccccgaggacaccgccgtctactactgcgccgtccccggccccatcttcggcatcttccccccctggtcctacttcgaccactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggc

SEQ ID NO: 20507 - RNA, 1047 nt, synthetic construct; identical to SEQ ID NO: 20506
  misc_feature 1..1047: note = derived and/or modified sequence opt2 from anti-influenza_Chain
  source 1..1047: mol_type = other RNA

SEQ ID NO: 20508 - RNA, 1047 nt, synthetic construct; identical to SEQ ID NO: 20505
  misc_feature 1..1047: note = derived and/or modified sequence opt2 from anti-influenza_Chain
  source 1..1047: mol_type = other RNA

SEQ ID NO: 20509 - RNA, 1161 nt, synthetic construct
  misc_feature 1..1161: note = derived and/or modified sequence opt2 from anti-influenza_Chain
  source 1..1161: mol_type = other RNA
atgaacaagttcctcaacaagaagtggtccctcatcctcaccatgggcggcatcttcctcatggccaccctctccctcatcttcgccaccggcaagaaggccttcaacgaccagacctccgccgaggacatcccctccctcgccgaggccttccgcgactacttccccatcggcgccgccatcgagcccggctacaccaccggccagatcgccgagctctacaagaagcacgtcaacatgctcgtcgccgagaacgccatgaagcccgcctccctccagcccaccgagggcaacttccagtgggccgacgccgaccgcatcgtccagttcgccaaggagaacggcatggagctccgcttccacaccctcgtctggcacaaccagacccccaccggcttctccctcgacaaggagggcaagcccatggtcgaggagaccgacccccagaagcgcgaggagaaccgcaagctcctcctccagcgcctcgagaactacatccgcgccgtcgtcctccgctacaaggacgacatcaagtcctgggacgtcgtcaacgaggtcatcgagcccaacgaccccggcggcatgcgcaactccccctggtaccagatcaccggcaccgagtacatcgaggtcgccttccgcgccacccgcgaggccggcggctccgacatcaagctctacatcaacgactacaacaccgacgaccccgtcaagcgcgacatcctctacgagctcgtcaagaacctcctcgagaagggcgtccccatcgacggcgtcggccaccagacccacatcgacatctacaacccccccgtcgagcgcatcatcgagtccatcaagaagttcgccggcctcggcctcgacaacatcatcaccgagctcgacatgtccatctactcctggaacgaccgctccgactacggcgactccatccccgactacatcctcaccctccaggccaagcgctaccaggagctcttcgacgccctcaaggagaacaaggacatcgtctccgccgtcgtcttctggggcatctccgacaagtactcctggctcaacggcttccccgtcaagcgcaccaacgcccccctcctcttcgaccgcaacttcatgcccaagcccgccttctgggccatcgtcgacccctcccgcctccgcgag

SEQ ID NO: 20510 - RNA, 1161 nt, synthetic construct; identical to SEQ ID NO: 20509
  misc_feature 1..1161: note = derived and/or modified sequence opt2 from anti-influenza_Chain
  source 1..1161: mol_type = other RNA

SEQ ID NO: 20511 - RNA, 1221 nt, synthetic construct
  misc_feature 1..1221: note = derived and/or modified sequence opt2 from anti-influenza_Chain
  source 1..1221: mol_type = other RNA
atgcgcaacgtcgtccgcaagcccctcaccatcggcctcgccctcaccctcctcctccccatgggcatgaccgccacctccgccaagaacgccgactcctacgccaagaagccccacatctccgccctcaacgccccccagctcgaccagcgctacaagaacgagttcaccatcggcgccgccgtcgagccctaccagctccagaacgagaaggacgtccagatgctcaagcgccacttcaactccatcgtcgccgagaacgtcatgaagcccatctccatccagcccgaggagggcaagttcaacttcgagcaggccgaccgcatcgtcaagttcgccaaggccaacggcatggacatccgcttccacaccctcgtctggcactcccaggtcccccagtggttcttcctcgacaaggagggcaagcccatggtcaacgagaccgaccccgtcaagcgcgagcagaacaagcagctcctcctcaagcgcctcgagacccacatcaagaccatcgtcgagcgctacaaggacgacatcaagtactgggacgtcgtcaacgaggtcgtcggcgacgacggcaagctccgcaactccccctggtaccagatcgccggcatcgactacatcaaggtcgccttccaggccgcccgcaagtacggcggcgacaacatcaagctctacatgaacgactacaacaccgaggtcgagcccaagcgcaccgccctctacaacctcgtcaagcagctcaaggaggagggcgtccccatcgacggcatcggccaccagtcccacatccagatcggctggccctccgaggccgagatcgagaagaccatcaacatgttcgccgccctcggcctcgacaaccagatcaccgagctcgacgtctccatgtacggctggcccccccgcgcctaccccacctacgacgccatccccaagcagaagttcctcgaccaggccgcccgctacgaccgcctcttcaagctctacgagaagctctccgacaagatctccaacgtcaccttctggggcatcgccgacaaccacacctggctcgactcccgcgccgacgtctactacgacgccaacggcaacgtcgtcgtcgaccccaacgccccctacgccaaggtcgagaagggcaagggcaaggacgcccccttcgtcttcggccccgactacaaggtcaagcccgcctactgggccatcatcgaccacaag

SEQ ID NO: 20512 - RNA, 1221 nt, synthetic construct; identical to SEQ ID NO: 20511
  misc_feature 1..1221: note = derived and/or modified sequence opt2 from anti-influenza_Chain
  source 1..1221: mol_type = other RNA

SEQ ID NO: 20513 - RNA, 1233 nt, synthetic construct
  misc_feature 1..1233: note = derived and/or modified sequence opt2 from anti-influenza_Chain
  source 1..1233: mol_type = other RNA
ctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20514 - RNA, 1233 nt, synthetic construct; identical to SEQ ID NO: 20513
  misc_feature 1..1233: note = derived and/or modified sequence opt2 from anti-influenza_Chain
  source 1..1233: mol_type = other RNA

SEQ ID NO: 20515 - RNA, 1293 nt, synthetic construct
  misc_feature 1..1293: note = derived and/or modified sequence opt2 from anti-influenza_Chain
  source 1..1293: mol_type = other RNA
atggacgaccacgccgagaagttcctctggggcgtcgccacctccgcctaccagatcgagggcgccacccaggaggacggccgcggcccctccatctgggacgccttcgcccgccgccccggcgccatccgcgacggctccaccggcgagcccgcctgcgaccactaccgccgctacgaggaggacatcgccctcatgcagtccctcggcgtccgcgcctaccgcttctccgtcgcctggccccgcatcctccccgagggccgcggccgcatcaaccccaagggcctcgccttctacgaccgcctcgtcgaccgcctcctcgcctccggcatcacccccttcctcaccctctaccactgggacctccccctcgccctcgaggagcgcggcggctggcgctcccgcgagaccgccttcgccttcgccgagtacgccgaggccgtcgcccgcgccctcgccgaccgcgtccccttcttcgccaccctcaacgagccctggtgctccgccttcctcggccactggaccggcgagcacgcccccggcctccgcaacctcgaggccgccctccgcgccgcccaccacctcctcctcggccacggcctcgccgtcgaggccctccgcgccgccggcgcccgccgcgtcggcatcgtcctcaacttcgcccccgcctacggcgaggaccccgaggccgtcgacgtcgccgaccgctaccacaaccgctacttcctcgaccccatcctcggcaagggctaccccgagtcccccttccgcgaccccccccccgtccccatcctctcccgcgacctcgagctcgtcgcccgccccctcgacttcctcggcgtcaactactacgcccccgtccgcgtcgcccccggcaccggcaccctccccgtccgctacctcccccccgagggccccgccaccgccatgggctgggaggtctaccccgagggcctccaccacctcctcaagcgcctcggccgcgaggtcccctggcccctctacgtcaccgagaacggcgccgcctaccccgacctctggaccggcgaggccgtcgtcgaggaccccgagcgcgtcgcctacctcgaggcccacgtcgaggccgccctccgcgcccgcgaggagggcgtcgacctccgcggctacttcgtctggtccctcatggacaacttcgagtgggccttcggctacacccgccgcttcggcctctactacgtcgacttcccctcccagcgccgcatccccaagcgctccgccctctggtaccgcgagcgcatcgcccgcgcccagacc

SEQ ID NO: 20516 - RNA, 1293 nt, synthetic construct
  misc_feature 1..1293: note = derived and/or modified sequence opt2 from anti-influenza_Chain
  source 1..1293: mol_type = other RNA
atgaccgagaacgccgagaagttcctctggggcgtcgccacctccgcctaccagatcgagggcgccacccaggaggacggccgcggcccctccatctgggacgccttcgcccagcgccccggcgccatccgcgacggctccaccggcgagcccgcctgcgaccactaccgccgctacgaggaggacatcgccctcatgcagtccctcggcgtccgcgcctaccgcttctccgtcgcctggccccgcatcctccccgagggccgcggccgcatcaaccccaagggcctcgccttctacgaccgcctcgtcgaccgcctcctcgcctccggcatcacccccttcctcaccctctaccactgggacctccccctcgccctcgaggagcgcggcggctggcgctcccgcgagaccgccttcgccttcgccgagtacgccgaggccgtcgcccgcgccctcgccgaccgcgtccccttcttcgccaccctcaacgagccctggtgctccgccttcctcggccactggaccggcgagcacgcccccggcctccgcaacctcgaggccgccctccgcgccgcccaccacctcctcctcggccacggcctcgccgtcgaggccctccgcgccgccggcgcccgccgcgtcggcatcgtcctcaacttcgcccccgcctacggcgaggaccccgaggccgtcgacgtcgccgaccgctaccacaaccgcttcttcctcgaccccatcctcggcaagggctaccccgagtcccccttccgcgaccccccccccgtccccatcctctcccgcgacctcgagctcgtcgcccgccccctcgacttcctcggcgtcaactactacgcccccgtccgcgtcgcccccggcaccggcaccctccccgtccgctacctcccccccgagggccccgccaccgccatgggctgggaggtctaccccgagggcctctaccacctcctcaagcgcctcggccgcgaggtcccctggcccctctacgtcaccgagaacggcgccgcctaccccgacctctggaccggcgaggccgtcgtcgaggaccccgagcgcgtcgcctacctcgaggcccacgtcgaggccgccctccgcgcccgcgaggagggcgtcgacctccgcggctacttcgtctggtccctcatggacaacttcgagtgggccttcggctacacccgccgcttcggcctctactacgtcgacttcccctcccagcgccgcatccccaagcgctccgccctctggtaccgcgagcgcatcgcccgcgcccagacc

SEQ ID NO: 20517 - RNA, 1293 nt, synthetic construct
  misc_feature 1..1293: note = derived and/or modified sequence opt2 from anti-influenza_Chain
  source 1..1293: mol_type = other RNA
atggccgagaacgccgagaagttcctctggggcgtcgccacctccgcctaccagatcgagggcgccacccaggaggacggccgcggcccctccatctgggacaccttcgcccgccgccccggcgccatccgcgacggctccaccggcgagcccgcctgcgaccactaccaccgctacgaggaggacatcgccctcatgcagtccctcggcgtcggcgtctaccgcttctccgtcgcctggccccgcatcctccccgagggccgcggccgcatcaaccccaagggcctcgccttctacgaccgcctcgtcgaccgcctcctcgccgccggcatcacccccttcctcaccctctaccactgggacctcccccaggccctcgaggaccgcggcggctggcgctcccgcgagaccgccttcgccttcgccgagtacgccgaggccgtcgcccgcgccctcgccgaccgcgtccccttcttcgccaccctcaacgagccctggtgctccgccttcctcggccactggaccggcgagcacgcccccggcctccgcaacctcgaggccgccctccgcgccgcccaccacctcctcctcggccacggcctcgccgtcgaggccctccgcgccgccggcgccaagcgcgtcggcatcgtcctcaacttcgcccccgtctacggcgaggaccccgaggccgtcgacgtcgccgaccgctaccacaaccgctacttcctcgaccccatcctcggccgcggctaccccgagtcccccttccaggaccccccccccacccccaacctctcccgcgacctcgagctcgtcgcccgccccctcgacttcctcggcgtcaactactacgcccccgtccgcgtcgcccccggcaccggccccctccccgtccgctacctcccccccgagggccccgtcaccgccatgggctgggaggtctaccccgagggcctctaccacctcctcaagcgcctcggccgcgaggtcccctggcccctctacatcaccgagaacggcgccgcctaccccgacctctggaccggcgaggccgtcgtcgaggaccccgagcgcgtcgcctacctcgaggcccacgtcgaggccgccctccgcgcccgcgaggagggcgtcgacctccgcggctacttcgtctggtccctcatggacaacttcgagtgggccttcggctacacccgccgcttcggcctctactacgtcgacttcccctcccagcgccgcatccccaagcgctccgccctctggtaccgcgagcgcatcgcccgcgcccagctc

SEQ ID NO: 20518 - RNA, 1293 nt, synthetic construct; identical to SEQ ID NO: 20515
  misc_feature 1..1293: note = derived and/or modified sequence opt2 from anti-influenza_Chain
  source 1..1293: mol_type = other RNA

SEQ ID NO: 20519 - RNA, 1293 nt, synthetic construct; identical to SEQ ID NO: 20516
  misc_feature 1..1293: note = derived and/or modified sequence opt2 from anti-influenza_Chain
  source 1..1293: mol_type = other RNA

SEQ ID NO: 20520 - RNA, 1293 nt, synthetic construct; identical to SEQ ID NO: 20517
  misc_feature 1..1293: note = derived and/or modified sequence opt2 from anti-influenza_Chain
  source 1..1293: mol_type = other RNA

SEQ ID NO: 20521 - RNA, 1296 nt, synthetic construct
  misc_feature 1..1296: note = derived and/or modified sequence opt2 from anti-influenza_Chain
  source 1..1296: mol_type = other RNA
atgttcaagcccaactaccacttcttccccatcaccggctggatgaacgaccccaacggcctcatcttctggaagggcaagtaccacatgttctaccagtacaacccccgcaagcccgagtggggcaacatctgctggggccacgccgtctccgacgacctcgtccactggcgccacctccccgtcgccctctaccccgacgacgagacccacggcgtcttctccggctccgccgtcgagaaggacggcaagatgttcctcgtctacacctactaccgcgaccccacccacaacaagggcgagaaggagacccagtgcgtcgccatgtccgagaacggcctcgacttcgtcaagtacgacggcaaccccgtcatctccaagccccccgaggagggcacccacgccttccgcgaccccaaggtcaaccgctccaacggcgagtggcgcatggtcctcggctccggcaaggacgagaagatcggccgcgtcctcctctacacctccgacgacctcttccactggaagtacgagggcgtcatcttcgaggacgagaccaccaaggagatcgagtgccccgacctcgtccgcatcggcgagaaggacatcctcatctactccatcacctccaccaactccgtcctcttctccatgggcgagctcaaggagggcaagctcaacgtcgagaagcgcggcctcctcgaccacggcaccgacttctacgccgcccagaccttcttcggcaccgaccgcgtcgtcgtcatcggctggctccagtcctggctccgcaccggcctctaccccaccaagcgcgagggctggaacggcgtcatgtccctcccccgcgagctctacgtcgagaacaacgagctcaaggtcaagcccgtcgacgagctcctcgccctccgcaagcgcaaggtcttcgagaccgccaagtccggcaccttcctcctcgacgtcaaggagaactcctacgagatcgtctgcgagttctccggcgagatcgagctccgcatgggcaacgagtccgaggaggtcgtcatcaccaagtcccgcgacgagctcatcgtcgacaccacccgctccggcgtctccggcggcgaggtccgcaagtccaccgtcgaggacgaggccaccaaccgcatccgcgccttcctcgactcctgctccgtcgagttcttcttcaacgactccatcgccttctccttccgcatccaccccgagaacgtctacaacatcctctccgtcaagtccaaccaggtcaagctcgaggtcttcgagctcgagaacatctggctc

SEQ ID NO: 20522 - RNA, 1296 nt, synthetic construct; identical to SEQ ID NO: 20521
  misc_feature 1..1296: note = derived and/or modified sequence opt2 from anti-influenza_Chain
  source 1..1296: mol_type = other RNA

SEQ ID NO: 20523 - RNA, 1323 nt, synthetic construct
  misc_feature 1..1323: note = derived and/or modified sequence opt2 from anti-influenza_Chain
  source 1..1323: mol_type = other RNA
gaggtcaagctcgtcgagtccggcggcggcctcgtccagcccggcggctccctccgcctctcctgcgccacctccggcttcaccttctccgactactacatgtcctgggtccgccagtcccccggcaaggccctcgagtggctcggcttcacccgctcccgcgtcctcggctacaccaccgactactccgcctccgtcaagggccgcttcaccatctcccgcgacaactcccagtccatcctctacctccagatgaactccctccgcggcgaggactccgccacctactactgcgcccgcgaccgccccatggactactggggccagggcacctccgtcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccacctggccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctggttcgtcgacgacgtcgaggtccacaccgcccagacccagccccgcgaggagcagttcaactccaccttccgctccgtctccgagctccccatcatgcaccaggactggctcaacggcaaggagttcaagtgccgcgtcaactccgccgccttccccgcccccatcgagaagaccatctccaagaccaagggccgccccaaggccccccaggtctacaccatccccccccccaaggagcagatggccaaggacaaggtctccctcacctgcatgatcaccgacttcttccccgaggacatcaccgtcgagtggcagtggaacggccagcccgccgagaactacaagaacacccagcccatcatggacaccgacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 20524 - RNA, 1323 nt, synthetic construct; identical to SEQ ID NO: 20523
  misc_feature 1..1323: note = derived and/or modified sequence opt2 from anti-influenza_Chain
  source 1..1323: mol_type = other RNA

SEQ ID NO: 20525 - RNA, 1329 nt, synthetic construct
  misc_feature 1..1329: note = derived and/or modified sequence opt2 from anti-influenza_Chain
  source 1..1329: mol_type = other RNA
gaggtccagctccagcagtccggccccgagctcgtcaagcccggcgcctccgtcaagatgtcctgcaaggcctccggctacaccttcacctcctacgtcatgcactgggtcaagcagaagcccggccagggcctcgagtggatcggctacatcaacccctacaacgacggcacccgctacaacgagaagttccgcgtcaaggccaccctcacctccgacaagtcctcctccaccgcctacatggagctctcctccctcacctccgaggactccgccgtctactactgcgcccgccgcggcctcatcaccacccccaccctcgactactggggccagggcaccaccctcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccacctggccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctgggtcgacgacgtcgaggtccacaccgcccagacccagccccgcgaggagcagttcaactccaccttccgctccgtctccgagctccccatcatgcaccaggactggctcaacggcaaggagttcaagtgccgcgtcaactccgccgccttccccgcccccatcgagaagaccatctccaagaccaagggccgccccaaggccccccaggtctacaccatccccccccccaaggagcagatggccaaggacaaggtctccctcacctgcatgatcaccgacttcttccccgaggacatcaccgtcgagtggcagtggaacggccagcccgccgagaactacaagaacacccagcccatcatggacaccgacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 20526 - RNA, 1329 nt, synthetic construct; identical to SEQ ID NO: 20525
  misc_feature 1..1329: note = derived and/or modified sequence opt2 from anti-influenza_Chain
  source 1..1329: mol_type = other RNA

SEQ ID NO: 20527 - RNA, 1332 nt, synthetic construct
  misc_feature 1..1332: note = derived and/or modified sequence opt2 from anti-influenza_Chain
  source 1..1332: mol_type = other RNA
aacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20528 - RNA, 1332 nt, synthetic construct; identical to SEQ ID NO: 20527
  misc_feature 1..1332: note = derived and/or modified sequence opt2 from anti-influenza_Chain
  source 1..1332: mol_type = other RNA

SEQ ID NO: 20529 - RNA, 1341 nt, synthetic construct
  misc_feature 1..1341: note = derived and/or modified sequence opt2 from anti-influenza_Chain
  source 1..1341: mol_type = other RNA
caggtccagctccaggagtccggccccggcctcgtcaagccctccgagaccctctccctcacctgcaccgtctccggcggcctcatcggcaccggctcctactactggggctggatccgccagacccccggcaagggcatggagtggatcggctccatctcctactccggctccacctactaccacccctccctcaagtcccgcgtcaccatctccgacgacacctccaagaaccagctcttcctcaagctccgctccgtcaccgccgccgacaccgcccagtactactgcgcccgctacaactggggcatccgctacttcgacttctggggccgcggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagacccgcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctcccccccgcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 20530 - RNA, 1341 nt, synthetic construct; identical to SEQ ID NO: 20529
  misc_feature 1..1341: note = derived and/or modified sequence opt2 from anti-influenza_Chain
  source 1..1341: mol_type = other RNA

SEQ ID NO: 20531 - RNA, 1344 nt, synthetic construct
  misc_feature 1..1344: note = derived and/or modified sequence opt2 from anti-influenza_Chain
  source 1..1344: mol_type = other RNA
gaggtccagctccaggagtccggccccggcctcgtcaagccctcccagaccctctccctcacctgcaacgtctccggcggctccatcaccggcgactacaagtggtcctggatccgccagccccccggcaagggcctcgagtggatcggccacatccactccaccggcaccacctactacaacccctccctccgctcccgcatcaccatctccatggacacctccaagaacaacctctccctccgcctcacctccgtcaccgccgccgacaccgccgtctactactgcgcctcccacaccctcacctccggccactacccccgcgacttcgacttctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcacctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcatggaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctccggcaag

SEQ ID NO: 20532 - RNA, 1350 nt, synthetic construct
  misc_feature 1..1350: note = derived and/or modified sequence opt2 from anti-influenza_Chain
  source 1..1350: mol_type = other RNA
caggtccagctccagcagtccggcgccgaggtcaagaagcccggctcctccgtcaaggtctcctgcaaggtctccggcgtcatcttctccggctccgccatctcctgggtccgccaggcccccggccagggcctcgagtggatgggcggcatctcccccctcttcggcaccaccaactacgcccagaagttccagggccgcgtcaccatcaccgccgaccagtccaccaacaccacctacatggaggtcaactccctccgctacgaggacaccgccgtctacttctgcgcccgcggccccaagtactactccgagtacatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20533 - RNA, 1350 nt, synthetic construct
  misc_feature 1..1350: note = derived and/or modified sequence opt2 from anti-influenza_Chain
  source 1..1350: mol_type = other RNA
caggtccagctcgtccagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcatgggcatgttcggcaccaccaactacgcccagaagttccagggccgcgtcaccatcaccgccgacgagttcacctccgccgcctacatggagctccgctccctccgctccgaggacaccgccgtctactactgcgcccgctcctccggctactaccccgagtacttccaggactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20534 - RNA, 1350 nt, synthetic construct
  misc_feature 1..1350: note = derived and/or modified sequence opt2 from anti-influenza_Chain
  source 1..1350: mol_type = other RNA
gaggtccagctcgtcgagtccggcgccgaggtcaagaagcccggctcctccgtcaaggtctcctgcaaggcctccggcggcaccttctcctcctacggcatctcctgggtccgccaggcccccggccagggcctcgagtggatgggcgacatcatcggcatgttcggctccaccaactacgcccagaacttccagggccgcctcaccatcaccgccgacgagtccacctccaccgcctacatggagctctcctccctccgctccgaggacaccgccgtctactactgcgcccgctcctccggctactaccccgcctacctcccccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20535 - RNA, 1350 nt, synthetic construct
  misc_feature 1..1350: note = derived and/or modified sequence opt2 from anti-influenza_Chain
  source 1..1350: mol_type = other RNA
gaggtccagctcgtcgagtccggcgccgaggtcaagaagcccggctcctccgtcaaggtctcctgcaaggcctccggcggcaccttctcctcctacgccatctcctgggtccgccaggcccccggccagggcctcgagtggatgggcggcatcatcggcatgttcggcaccgccaactacgcccagaagttccagggccgcgtcaccatcaccgccgacgagttcacctccaccgcctacatggagctctcctccctccgctccgaggacaccgccgtctactactgcgcccgcggcaactactactacgagtcctccctcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20536 - RNA, 1350 nt, synthetic construct
  misc_feature 1..1350: note = derived and/or modified sequence opt2 from anti-influenza_Chain
  source 1..1350: mol_type = other RNA
gaggtccagctcgtccagtccggcgccgaggtcaagaagcccggctcctccatgaaggtctcctgcaaggcctccggctccatcttctccaactacggcatctcctgggtccgccaggcccccggccagggcctcgagtggatgggcggcatcatccccatcttcggcgccgccaactacgcccagaagttccagggccgcgtcaccatcaccgccgacgagtccacctccaccgtctacatggaggtccgctccctccgctccgaggacaccgccgtctactactgcgcccgccgccagcagctctacaagggctactaccaccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20537 - RNA, 1350 nt, synthetic construct
  misc_feature 1..1350: note = derived and/or modified sequence opt2 from anti-influenza_Chain
  source 1..1350: mol_type = other RNA
caggtccagctcgtccagtccggcgccggcgtcaagaagcccggctcctccatgaaggtctcctgcaaggcctccggctccatcttctccaactacggcatctcctgggtccgccaggcccccggccagggcctcgagtggatgggcggcatcatccccatcttcggcgccgccaactacgcccagaagttccagggccgcgtcaccatcaccgccgacgagtccacctccaccgtctacatggaggtccgctccctccgctccgaggacaccgccgtctactactgcgcccgccgccagcagctctacaagggctactaccaccactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20538 - RNA, 1350 nt, synthetic construct
  misc_feature 1..1350: note = derived and/or modified sequence opt2 from anti-influenza_Chain
  source 1..1350: mol_type = other RNA
caggtccagctcgtccagtccggcgccgaggtccgcaagcccggctcctccgtcaaggtctcctgcaaggtctccggcggcatcatccgcaagtacgccatcaactgggtccgccaggcccccggccagggcctcgagtggatgggcggcatcatcgccatcttcaacaccgccaactacgcccagaagttccagggccgcgtcaccatcaccgccgacgagtccacctccaccgtctacatggagctctcctccctccgctccgaggacaccgccctctactactgcgcccgcggcatgaactactactccgactacttcgactactggggccagggctccctcgtcaccgtctcccccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20539 - RNA, 1350 nt, synthetic construct; identical to SEQ ID NO: 20538
  misc_feature 1..1350: note = derived and/or modified sequence opt2 from anti-influenza_Chain
  source 1..1350: mol_type = other RNA

SEQ ID NO: 20540 - RNA, 1350 nt, synthetic construct; identical to SEQ ID NO: 20536
  misc_feature 1..1350: note = derived and/or modified sequence opt2 from anti-influenza_Chain
  source 1..1350: mol_type = other RNA

SEQ ID NO: 20541 - RNA, 1350 nt, synthetic construct; identical to SEQ ID NO: 20537
  misc_feature 1..1350: note = derived and/or modified sequence opt2 from anti-influenza_Chain
  source 1..1350: mol_type = other RNA

SEQ ID NO: 20542 - RNA, 1350 nt, synthetic construct; identical to SEQ ID NO: 20532
  misc_feature 1..1350: note = derived and/or modified sequence opt2 from anti-influenza_Chain
  source 1..1350: mol_type = other RNA

SEQ ID NO: 20543 - RNA, 1350 nt, synthetic construct; identical to SEQ ID NO: 20533
  misc_feature 1..1350: note = derived and/or modified sequence opt2 from anti-influenza_Chain
  source 1..1350: mol_type = other RNA

SEQ ID NO: 20544 - RNA, 1350 nt, synthetic construct; identical to SEQ ID NO: 20534
  misc_feature 1..1350: note = derived and/or modified sequence opt2 from anti-influenza_Chain
  source 1..1350: mol_type = other RNA

SEQ ID NO: 20545 - RNA, 1350 nt, synthetic construct; identical to SEQ ID NO: 20535
  misc_feature 1..1350: note = derived and/or modified sequence opt2 from anti-influenza_Chain
  source 1..1350: mol_type = other RNA

SEQ ID NO: 20546 - RNA, 1353 nt, synthetic construct
  misc_feature 1..1353: note = derived and/or modified sequence opt2 from anti-influenza_Chain
  source 1..1353: mol_type = other RNA
gaggtccagctcgtcgagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20547 - RNA, 1353 nt, synthetic construct
  misc_feature 1..1353: note = derived and/or modified sequence opt2 from anti-influenza_Chain
  source 1..1353: mol_type = other RNA
caggtccagctcgtccagtccggcgccgaggtcaagaagcccggctcctccgtcaaggtctcctgcaaggcctccggcggccccttccgctcctacgccatctcctgggtccgccaggcccccggccagggccccgagtggatgggcggcatcatccccatcttcggcaccaccaagtacgcccccaagttccagggccgcgtcaccatcaccgccgacgacttcgccggcaccgtctacatggagctctcctccctccgctccgaggacaccgccatgtactactgcgccaagcacatgggctaccaggtccgcgagaccatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20548 - RNA, 1353 nt, synthetic construct
  misc_feature 1..1353: note = derived and/or modified sequence opt2 from anti-influenza_Chain
  source 1..1353: mol_type = other RNA
gaggtccagctcgtcgagtccggcgccgaggtcaagaagcccggctcctccgtcaaggtctcctgcaaggcctccggcggcaccttctccttctactccatgtcctgggtccgccaggcccccggccagggcctcgagtggatgggcggcatcatccccatgttcggcaccaccaactacgcccagaagttccagggccgcgtcaccatcaccgccgtcgagtccacctccaccgcctacatggaggtctcctccctccgctccgaggacaccgccgtctactactgcgcccgcggcgacaagggcatctactactactacatggacgtctggggcaagggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20549 - RNA, 1353 nt, synthetic construct; identical to SEQ ID NO: 20546
  misc_feature 1..1353: note = derived and/or modified sequence opt2 from anti-influenza_Chain
  source 1..1353: mol_type = other RNA

SEQ ID NO: 20550 - RNA, 1353 nt, synthetic construct; identical to SEQ ID NO: 20547
  misc_feature 1..1353: note = derived and/or modified sequence opt2 from anti-influenza_Chain
  source 1..1353: mol_type = other RNA

SEQ ID NO: 20551 - RNA, 1353 nt, synthetic construct; identical to SEQ ID NO: 20548
  misc_feature 1..1353: note = derived and/or modified sequence opt2 from anti-influenza_Chain
  source 1..1353: mol_type = other RNA

SEQ ID NO: 20552 - RNA, 1356 nt, synthetic construct
  misc_feature 1..1356: note = derived and/or modified sequence opt2 from anti-influenza_Chain
  source 1..1356: mol_type = other RNA
caggtccagctcgtccagtccggcggcggcctcgtcaagcccggcggctccctccgcctctcctgcgccgcctccggcttcaccttctcctcctactccatgaactgggtccgccaggcccccggcaagggcctcgagtgggtctcctccatctcctcctcctcctcctacatctactacgtcgactccgtcaagggccgcttcaccatctcccgcgacaacgccaagaactccctctacctccagatgaactccctccgcgccgaggacaccgccgtctactactgcgcccgcggcggcggctcctacggcgcctacgagggcttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20553 - RNA, 1356 nt, synthetic construct
  misc_feature 1..1356: note = derived and/or modified sequence opt2 from anti-influenza_Chain
  source 1..1356: mol_type = other RNA
caggtccagctcgtccagtccggcgccgaggtcaagcagcccggcgcctccgtcaaggtctcctgcaaggcctccggctacaccttcaacgcctactacatccactgggtccgccaggcccccggccagggcctcgagtggatgggctggatcaaccccaacttcggcggcacccactacgcccgcaagttccagggccgcgtcaccatgacccgcgacgcctccatcaacaccgcctacatggagctcgaccgcctcatctccgacgacaccgccgtctactactgcgtccgctggcgcgccgccgccgtcatcatggaccagttctacaagatggacgtctggggccagggcaccctcgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagacccgcgagtccaagtacggccccccctgcccctcctgccccgcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaagggccagccccgcgagccccaggtctacaccctcccccccgcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggcaag

SEQ ID NO: 20554 - RNA, 1356 nt, synthetic construct
  misc_feature 1..1356: note = derived and/or modified sequence opt2 from anti-influenza_Chain
  source 1..1356: mol_type = other RNA
gaggtccagctcgtccagtccggcgccgaggtcaagaagcccggcgcctccgtcaaggtctcctgcaaggcctccggctacatcttcaccggctactacatccactgggtccgccaggcccccggccagggcctcgagtggatgggccgcatcgaccccaacggcgccggcaccacctacgcccagaagttccagggccgcgtcaccctcaccatggacacctccatcaccaccgcctacatggagctctcccgcctccgcttcgacgacaccgccatctactactgcgcccgctgggactggaacttcgacctctacctcggctggttcgacccctggggccagggcacccccgtcaccgtcgcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgcgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20555 - RNA, 1356 nt, synthetic construct; identical to SEQ ID NO: 20553
  misc_feature 1..1356: note = derived and/or modified sequence opt2 from anti-influenza_Chain
  source 1..1356: mol_type = other RNA

SEQ ID NO: 20556 - RNA, 1356 nt, synthetic construct; identical to SEQ ID NO: 20552
  misc_feature 1..1356: note = derived and/or modified sequence opt2 from anti-influenza_Chain
  source 1..1356: mol_type = other RNA

SEQ ID NO: 20557 - RNA, 1356 nt, synthetic construct; identical to SEQ ID NO: 20554
  misc_feature 1..1356: note = derived and/or modified sequence opt2 from anti-influenza_Chain
  source 1..1356: mol_type = other RNA

SEQ ID NO: 20558 - RNA, 1359 nt, synthetic construct
  misc_feature 1..1359: note = derived and/or modified sequence opt2 from anti-influenza_Chain
  source 1..1359: mol_type = other RNA
caggtccagctcgtccagtccggcgccgaggtcaagaagcccggctcctccgtccgcgtctcctgcaaggcctccggctccatcttccgcaactacgccatgtcctgggtccgccaggcccccggccagggcctcgagtggatgggcggcatcatcgccatcttcggcacccccaagtacgcccagaagttccagggccgcgtcaccatcaccgccgacgagtccacctccaccgtctacatggagctctccggcctccgctccgaggacaccgccatgtactactgcgcccgcatcccccactacaacttcggctccggctcctacttcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20559 - RNA, 1359 nt, synthetic construct
  misc_feature 1..1359: note = derived and/or modified sequence opt2 from anti-influenza_Chain
  source 1..1359: mol_type = other RNA
caggtccagctcgtccagtccggcgccgaggtcaagaagcccggcgcctccgtcaaggtctcctgcaaggcctccggctacatcttcaccggctactacatccactgggtccgccaggcccccggccagggcctcgagtggatgggccgcatcgaccccaacggctccggcaccacctacgcccagaagttccagggccgcgtcaccctcaccatggacacctccatcaccaccgcctacatggagctctcccgcctccgcttcgacgacaccgccatctactactgcgcccgctgggactggaacttcgacctctacctcggctggttcgacccctggggccagggcacccccgtcaccgtcgcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20560 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgcctccgtcaaggtctcctgcaaggcctccggctacatcttcaccggctactacatccactgggtccgccaggcccccggccagggcctcgagtggatgggccgcatcgaccccaacggcgccggcaccacctacgcccagaagttccagggccgcgtcaccctcaccatggacacctccatcaccaccgcctacatggagctctcccgcctccgcttcgacgacaccgccatctactactgcgcccgctgggactggaacttcgacctctacctcggctggttcgacccctggggccagggcacccccgtcaccgtcgcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20561 - RNA, 1359 nt, synthetic construct
  misc_feature 1..1359: note = derived and/or modified sequence opt2 from anti-influenza_Chain
  source 1..1359: mol_type = other RNA
caggtccagctcgtccagtccggcgccgaggtcaagaagcccggcgcctccgtcaaggtctcctgcaaggcctccggctacaccttcaacgcccaccacatgcactgggtccgccaggcccccggccagggcctcggctggatgggctggatcgaccccaacaacgacggcaccatctacgcccagaagttccagggccgcgtcaccctcaccatggacacctccatccacaccgcctacatggagctctccggcctccgctacgacgacaccgccatctactactgcgtccgctgggcctggaacttcgacttcttcctcggctggttcgacccctggggccagggcaccctcgtcaccgtcgcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20562 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgactccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20563 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgacgccgacgccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20564 - RNA, 1359 nt, synthetic construct; identical to SEQ ID NO: 16307
  misc_feature 1..1359: note = derived and/or modified sequence opt2 from anti-influenza_Chain
  source 1..1359: mol_type = other RNA

SEQ ID NO: 20565 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgacgccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20566 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggctcctccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20567 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgactccgacgccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20568 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgacaccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20569 - RNA, 1359 nt, synthetic construct
  misc_feature 1..1359: note = derived and/or modified sequence opt2 from anti-influenza_Chain
  source 1..1359: mol_type = other RNA
gaggtccagctcgtccagtccggcgccgaggtcaagaagcccggcgagtccctcaagatctcctgcaaggtctccggctactccttcacctcccagtggatcggctgggtccgccagatgcccggcaagggcctcgagtggatcggcatgatgtaccccggcgagtccgacaccatctactccccctccttccagggccaggtcaccatctccgccgacaactccatctccaccgcctacctccagtggtcctccctcaaggcctccgacaccgccatctactactgcgcctccggccccggctactccggctaccactacggctggttcgacacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20570 - RNA, 1359 nt, synthetic construct; identical to SEQ ID NO: 20558
  misc_feature 1..1359: note = derived and/or modified sequence opt2 from anti-influenza_Chain
  source 1..1359: mol_type = other RNA

SEQ ID NO: 20571 - RNA, 1359 nt, synthetic construct; identical to SEQ ID NO: 20559
  misc_feature 1..1359: note = derived and/or modified sequence opt2 from anti-influenza_Chain
  source 1..1359: mol_type = other RNA

SEQ ID NO: 20572 - RNA, 1359 nt, synthetic construct; identical to SEQ ID NO: 20560
  misc_feature 1..1359: note = derived and/or modified sequence opt2 from anti-influenza_Chain
  source 1..1359: mol_type = other RNA

SEQ ID NO: 20573 - RNA, 1359 nt, synthetic construct; identical to SEQ ID NO: 20561
  misc_feature 1..1359: note = derived and/or modified sequence opt2 from anti-influenza_Chain
  source 1..1359: mol_type = other RNA

SEQ ID NO: 20574 - RNA, 1359 nt, synthetic construct; identical to SEQ ID NO: 20562
  misc_feature 1..1359: note = derived and/or modified sequence opt2 from anti-influenza_Chain
  source 1..1359: mol_type = other RNA

SEQ ID NO: 20575 - RNA, 1359 nt, synthetic construct; identical to SEQ ID NO: 20563
  misc_feature 1..1359: note = derived and/or modified sequence opt2 from anti-influenza_Chain
  source 1..1359: mol_type = other RNA

SEQ ID NO: 20576 - RNA, 1359 nt, synthetic construct; identical to SEQ ID NO: 16307
  misc_feature 1..1359: note = derived and/or modified sequence opt2 from anti-influenza_Chain
  source 1..1359: mol_type = other RNA

SEQ ID NO: 20577 - RNA, 1359 nt, synthetic construct; identical to SEQ ID NO: 20565
  misc_feature 1..1359: note = derived and/or modified sequence opt2 from anti-influenza_Chain
  source 1..1359: mol_type = other RNA

SEQ ID NO: 20578 - RNA, 1359 nt, synthetic construct; identical to SEQ ID NO: 20566
  misc_feature 1..1359: note = derived and/or modified sequence opt2 from anti-influenza_Chain
  source 1..1359: mol_type = other RNA

SEQ ID NO: 20579 - RNA, 1359 nt, synthetic construct; identical to SEQ ID NO: 20567
  misc_feature 1..1359: note = derived and/or modified sequence opt2 from anti-influenza_Chain
  source 1..1359: mol_type = other RNA

SEQ ID NO: 20580 - RNA, 1359 nt, synthetic construct; identical to SEQ ID NO: 20568
  misc_feature 1..1359: note = derived and/or modified sequence opt2 from anti-influenza_Chain
  source 1..1359: mol_type = other RNA

SEQ ID NO: 20581 - RNA, 1359 nt, synthetic construct; identical to SEQ ID NO: 20569
  misc_feature 1..1359: note = derived and/or modified sequence opt2 from anti-influenza_Chain
  source 1..1359: mol_type = other RNA

SEQ ID NO: 20582 - RNA, 1365 nt, synthetic construct
  misc_feature 1..1365: note = derived and/or modified sequence opt2 from anti-influenza_Chain
  source 1..1365: mol_type = other RNA
caggtccagctcgtcgagtccggcggcggcgtcgtccagcccggccgctccctccgcctctcctgcgccgcctccggcttcgccttccacaaccgcgccatgcactgggtccgccaggcccccggcaagggcctcgagtgggtcgccctcatctacttcgacggctccaagcagtactacgccgactccgtcaagggccgcttcaccatctcccgcgacaactccaagaacaccgtcttcctccagatgaactccctccgccccgaggacaccgccgtctactactgcgccgtccccggccccatcttcggcatcttccccccctggtcctacttcgaccactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20583 - RNA, 1365 nt, synthetic construct
  misc_feature 1..1365: note = derived and/or modified sequence opt2 from anti-influenza_Chain
  source 1..1365: mol_type = other RNA
gaggtccagctcgtcgagtccggcggcggcgtcgtccagcccggccgctccctccgcctctcctgcgccgcctccggcttcgccttccacaaccgcgccatgcactgggtccgccaggcccccggcaagggcctcgagtgggtcgccctcatctacttcgacggctccaagcagtactacgccgactccgtcaagggccgcttcaccatctcccgcgacaactccaagaacaccgtcttcctccagatgaactccctccgccccgaggacaccgccgtctactactgcgccgtccccggccccatcttcggcatcttccccccctggtcctacttcgaccactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20584 - RNA, 1365 nt, synthetic construct
  misc_feature 1..1365: note = derived and/or modified sequence opt2 from anti-influenza_Chain
  source 1..1365: mol_type = other RNA
gaggtccagctcgtccagtccggcggcggcgtcgtccagcccggcaagtccctccgcctctcctgcgccgcctccggcctcaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20585 - RNA, 1365 nt, synthetic construct
  misc_feature 1..1365: note = derived and/or modified sequence opt2 from anti-influenza_Chain
  source 1..1365: mol_type = other RNA
caggtccagctcgtcgagtccggcggcggcgtcgtccagcccggcaagtccctccgcctctcctgcgccgcctccggcctcaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20586 - RNA, 1365 nt, synthetic construct
  misc_feature 1..1365: note = derived and/or modified sequence opt2 from anti-influenza_Chain
  source 1..1365: mol_type = other RNA
caggtccagctcgtcgagtccggcggcggcgtcgtccagcccggcaagtccccccgcctctcctgcgccgcctccggccccaccttctcctcctacgccgtccactgggtccgccaggcccccggcaagggcctcgagtgggtcaccctcatctcctacgacggcgccaaccagtactacgccgactccgtcaagggccgcttcaccatctcccgcgacaactccaagaacaccgtctacctccagatgaactccctccgccccgaggacaccgccgtctactactgcgccgtccccggccccgtcttcggcatcttccccccctggtcctacttcgacaactggggccagggcatcctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20587 - RNA, 1365 nt, synthetic construct; identical to SEQ ID NO: 16291
  misc_feature 1..1365: note = derived and/or modified sequence opt2 from anti-influenza_Chain
  source 1..1365: mol_type = other RNA

SEQ ID NO: 20588 - RNA, 1365 nt, synthetic construct
  misc_feature 1..1365: note = derived and/or modified sequence opt2 from anti-influenza_Chain
  source 1..1365: mol_type = other RNA
caggtccagctcgtccagtccggcgccgagctcaagcgccccggcgcctccgtcaaggtctcctgcaagacctccggctactccttcaacaactacggcatcaactgggtccgccaggcccccggccagggcctcgagtggatgggctggatctccgcctacaccggcaacacccactacgccaagaacttcgagggccgcgtcaccctcaccaccgacacctccacctccaccgcctacatggaggtccgctccctccgctccgacgactccgccgtctacttctgcgcccgcgccatgatccagggcgtcgtcaccctctacctccgccccggcgactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20589 - RNA, 1365 nt, synthetic construct; identical to SEQ ID NO: 20582
  misc_feature 1..1365: note = derived and/or modified sequence opt2 from anti-influenza_Chain
  source 1..1365: mol_type = other RNA

SEQ ID NO: 20590 - RNA, 1365 nt, synthetic construct; identical to SEQ ID NO: 20583
  misc_feature 1..1365: note = derived and/or modified sequence opt2 from anti-influenza_Chain
  source 1..1365: mol_type = other RNA

SEQ ID NO: 20591 - RNA, 1365 nt, synthetic construct; identical to SEQ ID NO: 20584
  misc_feature 1..1365: note = derived and/or modified sequence opt2 from anti-influenza_Chain
  source 1..1365: mol_type = other RNA

SEQ ID NO: 20592 - RNA, 1365 nt, synthetic construct; identical to SEQ ID NO: 20585
  misc_feature 1..1365: note = derived and/or modified sequence opt2 from anti-influenza_Chain
  source 1..1365: mol_type = other RNA

SEQ ID NO: 20593 - RNA, 1365 nt, synthetic construct; identical to SEQ ID NO: 20586
  misc_feature 1..1365: note = derived and/or modified sequence opt2 from anti-influenza_Chain
  source 1..1365: mol_type = other RNA

SEQ ID NO: 20594 - RNA, 1365 nt, synthetic construct; identical to SEQ ID NO: 16291
  misc_feature 1..1365: note = derived and/or modified sequence opt2 from anti-influenza_Chain
  source 1..1365: mol_type = other RNA

SEQ ID NO: 20595 - RNA, 1365 nt, synthetic construct; identical to SEQ ID NO: 20588
  misc_feature 1..1365: note = derived and/or modified sequence opt2 from anti-influenza_Chain
  source 1..1365: mol_type = other RNA

SEQ ID NO: 20596 - RNA, 1368 nt, synthetic construct
  misc_feature 1..1368: note = derived and/or modified sequence opt2 from anti-influenza_Chain
  source 1..1368: mol_type = other RNA
gaggtccagctcgtccagtccggcggcggcgtcgtccagccccgccgctccctccgcctctcctgcgccgcctccggcttcaccttctcctcctacgccatgcactgggtccgccaggcccccggcaagggcctcgagtgggtcgccgtcatctcctacgacggccgcaacaagtactacgccgactccgtcaagggccgcttcaccgtctcccgcgacaactccaagaacaccctctacctccagatgaactccctccgcgccgaggacacctccgtctactactgcgcccgcgagctcctcatggactactacgaccacatcggctactcccccggccccacctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20597 - RNA, 1371 nt, synthetic construct
  misc_feature 1..1371: note = derived and/or modified sequence opt2 from anti-influenza_Chain
  source 1..1371: mol_type = other RNA
atggtcatccagcgcaactccatcctcctcctcatcatcatcttcgcctcctccatctccacctgccgctccaacgtcatcgacgacaacctcttcaagcaggtctacgacaacatcctcgagcaggagttcgcccacgacttccaggcctacctctcctacctctccaagaacatcgagtccaacaacaacatcgacaaggtcgacaagaacggcatcaaggtcatcaacgtcctctccttcggcgccaagggcgacggcaagacctacgacaacatcgccttcgagcaggcctggaacgaggcctgctcctcccgcacccccgtccagttcgtcgtccccaagaacaagaactacctcctcaagcagatcaccttctccggcccctgccgctcctccatctccgtcaagatcttcggctccctcgaggcctcctccaagatctccgactacaaggaccgccgcctctggatcgccttcgactccgtccagaacctcgtcgtcggcggcggcggcaccatcaacggcaacggccaggtctggtggccctcctcctgcaagatcaacaagtccctcccctgccgcgacgcccccaccgccctcaccttctggaactgcaagaacctcaaggtcaacaacctcaagtccaagaacgcccagcagatccacatcaagttcgagtcctgcaccaacgtcgtcgcctccaacctcatgatcaacgcctccgccaagtcccccaacaccgacggcgtccacgtctccaacacccagtacatccagatctccgacaccatcatcggcaccggcgacgactgcatctccatcgtctccggctcccagaacgtccaggccaccaacatcacctgcggccccggccacggcatctccatcggctccctcggctccggcaactccgaggcctacgtctccaacgtcaccgtcaacgaggccaagatcatcggcgccgagaacggcgtccgcatcaagacctggcagggcggctccggccaggcctccaacatcaagttcctcaacgtcgagatgcaggacgtcaagtaccccatcatcatcgaccagaactactgcgaccgcgtcgagccctgcatccagcagttctccgccgtccaggtcaagaacgtcgtctacgagaacatcaagggcacctccgccaccaaggtcgccatcaagttcgactgctccaccaacttcccctgcgagggcatcatcatggagaacatcaacctcgtcggcgagtccggcaagccctccgaggccacctgcaagaacgtccacttcaacaacgccgagcacgtcaccccccactgcacctccctcgagatctccgaggacgaggccctcctctacaactac

SEQ ID NO: 20598 - RNA, 1371 nt, synthetic construct; identical to SEQ ID NO: 20597
  misc_feature 1..1371: note = derived and/or modified sequence opt2 from anti-influenza_Chain
  source 1..1371: mol_type = other RNA

SEQ ID NO: 20599 - RNA, 1380 nt, synthetic construct
  misc_feature 1..1380: note = derived and/or modified sequence opt2 from anti-influenza_Chain
  source 1..1380: mol_type = other RNA
atgaagctctggctcaactggatcttcctcgtcaccctcctcaacgacatccagtgcgaggtcaagctcgtcgagtccggcggcggcctcgtccagcccggcggctccctccgcctctcctgcgccacctccggcttcaccttctccgactactacatgtcctgggtccgccagtcccccggcaaggccctcgagtggctcggcttcacccgctcccgcgtcctcggctacaccaccgactactccgcctccgtcaagggccgcttcaccatctcccgcgacaactcccagtccatcctctacctccagatgaactccctccgcggcgaggactccgccacctactactgcgcccgcgaccgccccatggactactggggccagggcacctccgtcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccacctggccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctggttcgtcgacgacgtcgaggtccacaccgcccagacccagccccgcgaggagcagttcaactccaccttccgctccgtctccgagctccccatcatgcaccaggactggctcaacggcaaggagttcaagtgccgcgtcaactccgccgccttccccgcccccatcgagaagaccatctccaagaccaagggccgccccaaggccccccaggtctacaccatccccccccccaaggagcagatggccaaggacaaggtctccctcacctgcatgatcaccgacttcttccccgaggacatcaccgtcgagtggcagtggaacggccagcccgccgagaactacaagaacacccagcccatcatggacaccgacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 20600 - RNA, 1380 nt, synthetic construct; identical to SEQ ID NO: 20599
  misc_feature 1..1380: note = derived and/or modified sequence opt2 from anti-influenza_Chain
  source 1..1380: mol_type = other RNA

SEQ ID NO: 20601 - RNA, 1386 nt, synthetic construct
  misc_feature 1..1386: note = derived and/or modified sequence opt2 from anti-influenza_Chain
  source 1..1386: mol_type = other RNA
atggagtggtcctggatcttcctcttcctcctctccggcaccgccggcgtccactccgaggtccagctccagcagtccggccccgagctcgtcaagcccggcgcctccgtcaagatgtcctgcaaggcctccggctacaccttcacctcctacgtcatgcactgggtcaagcagaagcccggccagggcctcgagtggatcggctacatcaacccctacaacgacggcacccgctacaacgagaagttccgcgtcaaggccaccctcacctccgacaagtcctcctccaccgcctacatggagctctcctccctcacctccgaggactccgccgtctactactgcgcccgccgcggcctcatcaccacccccaccctcgactactggggccagggcaccaccctcaccgtctcctccgccaagaccacccccccctccgtctaccccctcgcccccggctccgccgcccagaccaactccatggtcaccctcggctgcctcgtcaagggctacttccccgagcccgtcaccgtcacctggaactccggctccctctcctccggcgtccacaccttccccgccgtcctccagtccgacctctacaccctctcctcctccgtcaccgtcccctcctccacctggccctccgagaccgtcacctgcaacgtcgcccaccccgcctcctccaccaaggtcgacaagaagatcgtcccccgcgactgcggctgcaagccctgcatctgcaccgtccccgaggtctcctccgtcttcatcttcccccccaagcccaaggacgtcctcaccatcaccctcacccccaaggtcacctgcgtcgtcgtcgacatctccaaggacgaccccgaggtccagttctcctgggtcgacgacgtcgaggtccacaccgcccagacccagccccgcgaggagcagttcaactccaccttccgctccgtctccgagctccccatcatgcaccaggactggctcaacggcaaggagttcaagtgccgcgtcaactccgccgccttccccgcccccatcgagaagaccatctccaagaccaagggccgccccaaggccccccaggtctacaccatccccccccccaaggagcagatggccaaggacaaggtctccctcacctgcatgatcaccgacttcttccccgaggacatcaccgtcgagtggcagtggaacggccagcccgccgagaactacaagaacacccagcccatcatggacaccgacggctcctacttcgtctactccaagctcaacgtccagaagtccaactgggaggccggcaacaccttcacctgctccgtcctccacgagggcctccacaaccaccacaccgagaagtccctctcccactcccccggcaag

SEQ ID NO: 20602 - RNA, 1386 nt, synthetic construct
  misc_feature 1..1386: note = derived and/or modified sequence opt2 from anti-influenza_Chain
  source 1..1386: mol_type = other RNA
caggtccagctcgtccagtccggcgccgaggtcaagaagcccggcgcctccgtcaaggtctcctgcaagacctccggctacaccttcaccgcctacaccatccactgggtccgccaggcccccggccagcgcctcgagtggatgggctggatcaacgccggcaacggccacaccaagtactcccagcgcttcaagggccgcgtcaccatcacccgcgacacctccgcccgcaccacctacatggagctccgctccctcacctccgaggacaccgccctctacttctgcgcccgcggccccgagacctactactacgacaagaccaactggctcaactcccaccccgacgagtacttccagcactggggccacggcacccaggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20603 - RNA, 1386 nt, synthetic construct; identical to SEQ ID NO: 20602
  misc_feature 1..1386: note = derived and/or modified sequence opt2 from anti-influenza_Chain
  source 1..1386: mol_type = other RNA

SEQ ID NO: 20604 - RNA, 1386 nt, synthetic construct; identical to SEQ ID NO: 20601
  misc_feature 1..1386: note = derived and/or modified sequence opt2 from anti-influenza_Chain
  source 1..1386: mol_type = other RNA

SEQ ID NO: 20605 - RNA, 1398 nt, synthetic construct
  misc_feature 1..1398: note = derived and/or modified sequence opt2 from anti-influenza_Chain
  source 1..1398: mol_type = other RNA
atgctcccctccaccgtccagaccctcaccctcctcctcacctccggcggcgtcctcctctccctctacgtctccgcctccctctcctacctcctctactccgacgtcctcctcaagttctcctccaccaagaccaccgcccccaccatgtccctcgagtgcaccaacgcctccaacgcccagaccgtcaaccactccgccaccaaggagatgaccttccccccccccgagcccgagtggacctacccccgcctctcctgccagggctccaccttccagaaggccctcctcatctccccccaccgcttcggcgagatcaagggcaactccgcccccctcatcatccgcgagcccttcgtcgcctgcggccccaaggagtgccgccacttcgccctcacccactacgccgcccagcccggcggctactacaacggcacccgcaaggaccgcaacaagctccgccacctcgtctccgtcaagctcggcaagatccccaccgtcgagaactccatcttccacatggccgcctggtccggctccgcctgccacgacggccgcgagtggacctacatcggcgtcgacggccccgacaacgacgccctcgtcaagatcaagtacggcgaggcctacaccgacacctaccactcctacgcccacaacatcctccgcacccaggagtccgcctgcaactgcatcggcggcgactgctacctcatgatcaccgacggctccgcctccggcatctccaagtgccgcttcctcaagatccgcgagggccgcatcatcaaggagatcctccccaccggccgcgtcgagcacaccgaggagtgcacctgcggcttcgcctccaacaagaccatcgagtgcgcctgccgcgacaactcctacaccgccaagcgccccttcgtcaagctcaacgtcgagaccgacaccgccgagatccgcctcatgtgcaccaagacctacctcgacaccccccgccccgacgacggctccatcgccggcccctgcgagtccaacggcgacaagtggctcggcggcatcaagggcggcttcgtccaccagcgcatggcctccaagatcggccgctggtactcccgcaccatgtccaagaccaaccgcatgggcatggagctctacgtcaagtacgacggcgacccctggaccgactccgacgccctcaccctctccggcgtcatggtctccatcgaggagcccggctggtactccttcggcttcgagatcaaggacaagaagtgcgacgtcccctgcatcggcatcgagatggtccacgacggcggcaaggacacctggcactccgccgccaccgccatctactgcctcatgggctccggccagctcctctgggacaccgtcaccggcgtcgacatggccctc

SEQ ID NO: 20606 - RNA, 1398 nt, synthetic construct; identical to SEQ ID NO: 20605
  misc_feature 1..1398: note = derived and/or modified sequence opt2 from anti-influenza_Chain
  source 1..1398: mol_type = other RNA

SEQ ID NO: 20607 - RNA, 1407 nt, synthetic construct
  misc_feature 1..1407: note = derived and/or modified sequence opt2 from anti-influenza_Chain
  source 1..1407: mol_type = other RNA
atggactggacctggcgcttcctcttcgtcgtcgccgccgccaccggcgtccagtcccaggtccagctcgtccagtccggcgccgaggtcaagaagcccggctcctccgtcaaggtctcctgcaaggcctccggcggcaccctcaacaactacgccatctcctgggtccgccaggcccccggccagggcctcgagtggatgggcggcatctcccccatcttcggcaccctcaactacgccgagcgcttccagggccgcgtcaccatcaccgccgacgtcttcaccaacaccgtctacatggagctctcctccctccgctccgaggacaccgccgtctacttctgcgcccgcggctgcggctacaactgctactacttcgacggctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 20608 - RNA, 1407 nt, synthetic construct; identical to SEQ ID NO: 20607
  misc_feature 1..1407: note = derived and/or modified sequence opt2 from anti-influenza_Chain
  source 1..1407: mol_type = other RNA

SEQ ID NO: 20609 - RNA, 1407 nt, synthetic construct; identical to SEQ ID NO: 20607
  misc_feature 1..1407: note = derived and/or modified sequence opt2 from anti-influenza_Chain
  source 1..1407: mol_type = other RNA

SEQ ID NO: 20610 - RNA, 1413 nt, synthetic construct
  misc_feature 1..1413: note = derived and/or modified sequence opt2 from anti-influenza_Chain
  source 1..1413: mol_type = other RNA
gacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20611 - RNA, 1413 nt, synthetic construct; identical to SEQ ID NO: 20610
  misc_feature 1..1413: note = derived and/or modified sequence opt2 from anti-influenza_Chain
  source 1..1413: mol_type = other RNA

SEQ ID NO: 20612 - RNA, 1416 nt, synthetic construct
  misc_feature 1..1416: note = derived and/or modified sequence opt2 from anti-influenza_Chain
  source 1..1416: mol_type = other RNA
atggactggacctggcgcttcctcttcgtcgtcgccgccgccaccggcgtccagtgccaggtccagctcgtccagtccggcgccgaggtcaagatgcccggctcctccgtcaaggtctcctgcaagacctccggcgtcttcttctcctcccacgccatctcctgggtccgccaggcccccggccagggcctcgagtggatgggcggcatctcccccatgttcggcaccacccactacgcccagaagttccagggccgcgtcaccatcaccgccgaccagtccaccaccaccgcctacatggagctcacctccctcacctccgaggacaccgccgtctactactgcgcccgcgacggcgccggctcctactaccccctcaactggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 20613 - RNA, 1416 nt, synthetic construct; identical to SEQ ID NO: 20612
  misc_feature 1..1416: note = derived and/or modified sequence opt2 from anti-influenza_Chain
  source 1..1416: mol_type = other RNA

SEQ ID NO: 20614 - RNA, 1416 nt, synthetic construct; identical to SEQ ID NO: 20612
  misc_feature 1..1416: note = derived and/or modified sequence opt2 from anti-influenza_Chain
  source 1..1416: mol_type = other RNA

SEQ ID NO: 20615 - RNA, 1419 nt, synthetic construct
  misc_feature 1..1419: note = derived and/or modified sequence opt2 from anti-influenza_Chain
  source 1..1419: mol_type = other RNA
atgaccgagtccgccatgacctcccgcgccggccgcggccgcggcgccgacctcgtcgccgccgtcgtccagggccacgccgccgcctccgacgccgccggcgacctctccttccccgacggcttcatctggggcgccgccaccgccgcctaccagatcgagggcgcctggcgcgaggacggccgcggcctctgggacgtcttctcccacacccccggcaaggtcgcctccggccacaccggcgacatcgcctgcgaccactaccaccgctacgccgacgacgtccgcctcatggccggcctcggcgaccgcgtctaccgcttctccgtcgcctggccccgcatcgtccccgacggctccggccccgtcaaccccgccggcctcgacttctacgaccgcctcgtcgacgagctcctcggccacggcatcaccccctaccccaccctctaccactgggacctcccccagaccctcgaggaccgcggcggctgggccgcccgcgacaccgcctaccgcttcgccgagtacgccctcgccgtccaccgccgcctcggcgaccgcgtccgctgctggatcaccctcaacgagccctgggtcgccgccttcctcgccacccaccgcggcgcccccggcgccgccgacgtcccccgcttccgcgccgtccaccacctcctcctcggccacggcctcggcctccgcctccgctccgccggcgccggccagctcggcctcaccctctccctctcccccgtcatcgaggcccgccccggcgtccgcggcggcggccgccgcgtcgacgccctcgccaaccgccagttcctcgaccccgccctccgcggccgctaccccgaggaggtcctcaagatcatggccggccacgcccgcctcggccaccccggccgcgacctcgagaccatccaccagcccgtcgacctcctcggcgtcaactactactcccacgtccgcctcgccgccgagggcgagcccgccaaccgcctccccggctccgagggcatccgcttcgagcgccccaccgccgtcaccgcctggcccggcgaccgccccgacggcctccgcaccctcctcctccgcctctcccgcgactaccccggcgtcggcctcatcatcaccgagaacggcgccgccttcgacgaccgcgccgacggcgaccgcgtccacgaccccgagcgcatccgctacctcaccgccaccctccgcgccgtccacgacgccatcatggccggcgccgacctccgcggctacttcgtctggtccgtcctcgacaacttcgagtgggcctacggctaccacaagcgcggcatcgtctacgtcgactacaccaccatgcgccgcatcccccgcgagtccgccctctggtaccgcgacgtcgtccgccgcaacggcctccgcaacggcgag

SEQ ID NO: 20616 - RNA, 1419 nt, synthetic construct; identical to SEQ ID NO: 20615
  misc_feature 1..1419: note = derived and/or modified sequence opt2 from anti-influenza_Chain
  source 1..1419: mol_type = other RNA

SEQ ID NO: 20617 - RNA, 1422 nt, synthetic construct
  misc_feature 1..1422: note = derived and/or modified sequence opt2 from anti-influenza_Chain
  source 1..1422: mol_type = other RNA
ctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctcggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20618 - RNA, 1422 nt, synthetic construct; identical to SEQ ID NO: 20617
  misc_feature 1..1422: note = derived and/or modified sequence opt2 from anti-influenza_Chain
  source 1..1422: mol_type = other RNA

SEQ ID NO: 20619 - RNA, 1428 nt, synthetic construct
  misc_feature 1..1428: note = derived and/or modified sequence opt2 from anti-influenza_Chain
  source 1..1428: mol_type = other RNA
atggagttcggcctctcctgggtcttcctcgtcgccctcctccgcggcgtccagtgccaggtccagctcgtcgagtccggcggcggcgtcgtccagcccggccgctccctccgcctctcctgcgccgcctccggcttcaccttctcccgcttcggcatccactgggtccgccaggcccccggcaagggcctcgagtggatggccgtcatctggtacgacggctccaacaagttctacgccgactccgtcaagggccgcttcaccatctcccgcgacaactccaagaacaccgtctacctccagatgaactccctccgcgccgaggacaccgccgtctactactgcgccaaggactcccgcggctactgctcctccatcatctgcttcgagggcggcctcgacaactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgagggcctccacaaccactacacccagaagtccctctccctctcccccggcaag

SEQ ID NO: 20620 - RNA, 1428 nt, synthetic construct; identical to SEQ ID NO: 20619
  misc_feature 1..1428: note = derived and/or modified sequence opt2 from anti-influenza_Chain
  source 1..1428: mol_type = other RNA

SEQ ID NO: 20621 - RNA, 1428 nt, synthetic construct; identical to SEQ ID NO: 20619
  misc_feature 1..1428: note = derived and/or modified sequence opt2 from anti-influenza_Chain
  source 1..1428: mol_type = other RNA

SEQ ID NO: 20622 - RNA, 1440 nt, synthetic construct
  misc_feature 1..1440: note = derived and/or modified sequence opt2 from anti-influenza_Chain
  source 1..1440: mol_type = other RNA
atgccctccgtcaagatcggcatcatcggcgccggctccgccgtcttctccctccgcctcgtctccgacctctgcaagacccccggcctctccggctccaccgtcaccctcatggacatcgacgaggagcgcctcgacgccatcctcaccatcgccaagaagtacgtcgaggaggtcggcgccgacctcaagttcgagaagaccatgaacctcgacgacgtcatcatcgacgccgacttcgtcatcaacaccgccatggtcggcggccacacctacctcgagaaggtccgccagatcggcgagaagtacggctactaccgcggcatcgacgcccaggagttcaacatggtctccgactactacaccttctccaactacaaccagctcaagtacttcgtcgacatcgcccgcaagatcgagaagctctcccccaaggcctggtacctccaggccgccaaccccatcttcgagggcaccaccctcgtcacccgcaccgtccccatcaaggccgtcggcttctgccacggccactacggcgtcatggagatcgtcgagaagctcggcctcgaggaggagaaggtcgactggcaggtcgccggcgtcaaccacggcatctggctcaaccgcttccgctacaacggcggcaacgcctaccccctcctcgacaagtggatcgaggagaagtccaaggactggaagcccgagaaccccttcaacgaccagctctcccccgccgccatcgacatgtaccgcttctacggcgtcatgcccatcggcgacaccgtccgcaactcctcctggcgctaccaccgcgacctcgagaccaagaagaagtggtacggcgagccctggggcggcgccgactccgagatcggctggaagtggtaccaggacaccctcggcaaggtcaccgagatcaccaagaaggtcgccaagttcatcaaggagaacccctccgtccgcctctccgacctcggctccgtcctcggcaaggacctctccgagaagcagttcgtcctcgaggtcgagaagatcctcgaccccgagcgcaagtccggcgagcagcacatccccttcatcgacgccctcctcaacgacaacaaggcccgcttcgtcgtcaacatccccaacaagggcatcatccacggcatcgacgacgacgtcgtcgtcgaggtccccgccctcgtcgacaagaacggcatccaccccgagaagatcgagccccccctccccgaccgcgtcgtcaagtactacctccgcccccgcatcatgcgcatggagatggccctcgaggccttcctcaccggcgacatccgcatcatcaaggagctcctctaccgcgacccccgcaccaagtccgacgagcaggtcgagaaggtcatcgaggagatcctcgccctccccgagaacgaggagatgcgcaagcactacctcaagcgc

SEQ ID NO: 20623 - RNA, 1440 nt, synthetic construct; identical to SEQ ID NO: 20622
  misc_feature 1..1440: note = derived and/or modified sequence opt2 from anti-influenza_Chain
  source 1..1440: mol_type = other RNA

SEQ ID NO: 20624 - RNA, 1443 nt, synthetic construct
  misc_feature 1..1443: note = derived and/or modified sequence opt2 from anti-influenza_Chain
  source 1..1443: mol_type = other RNA
atgaagttccccaaggacttcatgatcggctactcctcctcccccttccagttcgaggccggcatccccggctccgaggaccccaactccgactggtgggtctgggtccacgaccccgagaacaccgccgccggcctcgtctccggcgacttccccgagaacggccccggctactggaacctcaaccagaacgaccacgacctcgccgagaagctcggcgtcaacaccatccgcgtcggcgtcgagtggtcccgcatcttccccaagcccaccttcaacgtcaaggtccccgtcgagcgcgacgagaacggctccatcgtccacgtcgacgtcgacgacaaggccgtcgagcgcctcgacgagctcgccaacaaggaggccgtcaaccactacgtcgagatgtacaaggactgggtcgagcgcggccgcaagctcatcctcaacctctaccactggcccctccccctctggctccacaaccccatcatggtccgccgcatgggccccgaccgcgccccctccggctggctcaacgaggagtccgtcgtcgagttcgccaagtacgccgcctacatcgcctggaagatgggcgagctccccgtcatgtggtccaccatgaacgagcccaacgtcgtctacgagcagggctacatgttcgtcaagggcggcttcccccccggctacctctccctcgaggccgccgacaaggcccgccgcaacatgatccaggcccacgcccgcgcctacgacaacatcaagcgcttctccaagaagcccgtcggcctcatctacgccttccagtggttcgagctcctcgagggccccgccgaggtcttcgacaagttcaagtcctccaagctctactacttcaccgacatcgtctccaagggctcctccatcatcaacgtcgagtaccgccgcgacctcgccaaccgcctcgactggctcggcgtcaactactactcccgcctcgtctacaagatcgtcgacgacaagcccatcatcctccacggctacggcttcctctgcacccccggcggcatctcccccgccgagaacccctgctccgacttcggctgggaggtctaccccgagggcctctacctcctcctcaaggagctctacaaccgctacggcgtcgacctcatcgtcaccgagaacggcgtctccgactcccgcgacgccctccgccccgcctacctcgtctcccacgtctactccgtctggaaggccgccaacgagggcatccccgtcaagggctacctccactggtccctcaccgacaactacgagtgggcccagggcttccgccagaagttcggcctcgtcatggtcgacttcaagaccaagaagcgctacctccgcccctccgccctcgtcttccgcgagatcgccacccacaacggcatccccgacgagctccagcacctcaccctcatccag

SEQ ID NO: 20625 - RNA, 1443 nt, synthetic construct; identical to SEQ ID NO: 20624
  misc_feature 1..1443: note = derived and/or modified sequence opt2 from anti-influenza_Chain
  source 1..1443: mol_type = other RNA

SEQ ID NO: 20626 - RNA, 1464 nt, synthetic construct
  misc_feature 1..1464: note = derived and/or modified sequence opt2 from anti-influenza_Chain
  source 1..1464: mol_type = other RNA
cacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20627 - RNA, 1464 nt, synthetic construct; identical to SEQ ID NO: 20626
  misc_feature 1..1464: note = derived and/or modified sequence opt2 from anti-influenza_Chain
  source 1..1464: mol_type = other RNA

SEQ ID NO: 20628 - RNA, 1473 nt, synthetic construct
  misc_feature 1..1473: note = derived and/or modified sequence opt2 from anti-influenza_Chain
  source 1..1473: mol_type = other RNA
atgctctccttccccaagggcttcaagttcggctggtcccagtccggcttccagtccgagatgggcacccccggctccgaggaccccaactccgactggcacgtctgggtccacgaccgcgagaacatcgtctcccaggtcgtctccggcgacctccccgagaacggccccggctactggggcaactacaagcgcttccacgacgaggccgagaagatcggcctcaacgccgtccgcatcaacgtcgagtggtcccgcatcttcccccgccccctccccaagcccgagatgcagaccggcaccgacaaggagaactcccccgtcatctccgtcgacctcaacgagtccaagctccgcgagatggacaactacgccaaccacgaggccctctcccactaccgccagatcctcgaggacctccgcaaccgcggcttccacatcgtcctcaacatgtaccactggaccctccccatctggctccacgaccccatccgcgtccgccgcggcgacttcaccggccccaccggctggctcaactcccgcaccgtctacgagttcgcccgcttctccgcctacgtcgcctggaagctcgacgacctcgcctccgagtacgccaccatgaacgagcccaacgtcgtctggggcgccggctacgccttcccccgcgccggcttcccccccaactacctctccttccgcctctccgagatcgccaagtggaacatcatccaggcccacgcccgcgcctacgacgccatcaagtccgtctccaagaagtccgtcggcatcatctacgccaacacctcctactaccccctccgcccccaggacaacgaggccgtcgagatcgccgagcgcctcaaccgctggtccttcttcgactccatcatcaagggcgagatcacctccgagggccagaacgtccgcgaggacctccgcaaccgcctcgactggatcggcgtcaactactacacccgcaccgtcgtcaccaaggccgagtccggctacctcaccctccccggctacggcgaccgctgcgagcgcaactccctctccctcgccaacctccccacctccgacttcggctgggagttcttccccgagggcctctacgacgtcctcctcaagtactggaaccgctacggcctccccctctacgtcatggagaacggcatcgccgacgacgccgactaccagcgcccctactacctcgtctcccacatctaccaggtccaccgcgccctcaacgagggcgtcgacgtccgcggctacctccactggtccctcgccgacaactacgagtggtcctccggcttctccatgcgcttcggcctcctcaaggtcgactacctcaccaagcgcctctactggcgcccctccgccctcgtctaccgcgagatcacccgctccaacggcatccccgaggagctcgagcacctcaaccgcgtcccccccatcaagcccctccgccac

SEQ ID NO: 20629 - RNA, 1473 nt, synthetic construct; identical to SEQ ID NO: 20628
  misc_feature 1..1473: note = derived and/or modified sequence opt2 from anti-influenza_Chain
  source 1..1473: mol_type = other RNA

SEQ ID NO: 20630 - RNA, 1494 nt, synthetic construct
  misc_feature 1..1494: note = derived and/or modified sequence opt2 from anti-influenza_Chain
  source 1..1494: mol_type = other RNA
atggcctcccagggcaccaagcgctcctacgagcagatggagaccgacggcgagcgccagaacgccaccgagatccgcgcctccgtcggcaagatgatcggcggcatcggccgcttctacatccagatgtgcaccgagctcaagctctccgactacgagggccgcctcatccagaactccctcaccatcgagcgcatggtcctctccgccttcgacgagcgccgcaacaagtacctcgaggagcacccctccgccggcaaggaccccaagaagaccggcggccccatctaccgccgcgtcaacggcaagtggatgcgcgagctcatcctctacgacaaggaggagatccgccgcatctggcgccaggccaacaacggcgacgacgccaccgccggcctcacccacatgatgatctggcactccaacctcaacgacgccacctaccagcgcacccgcgccctcgtccgcaccggcatggacccccgcatgtgctccctcatgcagggctccaccctcccccgccgctccggcgccgccggcgccgccgtcaagggcgtcggcaccatggtcatggagctcgtccgcatgatcaagcgcggcatcaacgaccgcaacttctggcgcggcgagaacggccgcaagacccgcatcgcctacgagcgcatgtgcaacatcctcaagggcaagttccagaccgccgcccagaaggccatgatggaccaggtccgcgagtcccgcgaccccggcaacgccgagttcgaggacctcaccttcctcgcccgctccgccctcatcctccgcggctccgtcgcccacaagtcctgcctccccgcctgcgtctacggccccgccgtcgcctccggctacgacttcgagcgcgagggctactccctcgtcggcatcgaccccttccgcctcctccagaactcccaggtctactccctcatccgccccaacgagaaccccgcccacaagtcccagctcgtctggatggcctgccactccgccgccttcgaggacctccgcgtcctctccttcatcaagggcaccaaggtcgtcccccgcggcaagctctccacccgcggcgtccagatcgcctccaacgagaacatggagaccatggagtcctccaccctcgagctccgctcccgctactgggccatccgcacccgctccggcggcaacaccaaccagcagcgcgcctccgccggccagatctccatccagcccaccttctccgtccagcgcaacctccccttcgaccgcaccaccgtcatggccgccttcaccggcaacaccgagggccgcacctccgacatgcgcaccgagatcatccgcatgatggagtccgcccgccccgaggacgtctccttccagggccgcggcgtcttcgagctctccgacgagaaggccgcctcccccatcgtcccctccttcgacatgtccaacgagggctcctacttcttcggcgacaacgccgaggagtacgacaac

SEQ ID NO: 20631 - RNA, 1494 nt, synthetic construct
  misc_feature 1..1494: note = derived and/or modified sequence opt2 from anti-influenza_Chain
  source 1..1494: mol_type = other RNA
atggcctcccagggcaccaagcgctcctacgagcagatggagaccgacggcgagcgccagaacgccaccgagatccgcgcctccgtcggcaagatgatcgacggcatcggccgcttctacatccagatgtgcaccgagctcaagctctccgactacgagggccgcctcatccagaactccctcaccatcgagcgcatggtcctctccgccttcgacgagcgccgcaacaagtacctcgaggagcacccctccgccggcaaggaccccaagaagaccggcggccccatctacaagcgcgtcgacggcaagtggatgcgcgagctcgtcctctacgacaaggaggagatccgccgcatctggcgccaggccaacaacggcgacgacgccaccgccggcctcacccacatgatgatctggcactccaacctcaacgacaccacctaccagcgcacccgcgccctcgtccgcaccggcatggacccccgcatgtgctccctcatgcagggctccaccctcccccgccgctccggcgccgccggcgccgccgtcaagggcgtcggcaccatggtcatggagctcatccgcatgatcaagcgcggcatcaacgaccgcaacttctggcgcggcgagaacggccgcaagacccgctccgcctacgagcgcatgtgcaacatcctcaagggcaagttccagaccgccgcccagcgcgccatgatggaccaggtccgcgagtcccgcaaccccggcaacgccgagatcgaggacctcatcttcctcgcccgctccgccctcatcctccgcggctccgtcgcccacaagtcctgcctccccgcctgcgtctacggccccgccatcgcctccggctacaacttcgagaaggagggctactccctcgtcggcatcgaccccttcaagctcctccagaactcccaggtctactccctcatccgccccaacgagaaccccgcccacaagtcccagctcgtctggatggcctgcaactccgccgccttcgaggacctccgcgtcctctccttcatccgcggcaccaaggtctccccccgcggcaagctctccacccgcggcgtccagatcgcctccaacgagaacatggacaccatggagtcctccaccctcgagctccgctcccgctactgggccatccgcacccgctccggcggcaacaccaaccagcagcgcgcctccgccggccagatctccgtccagcccgccttctccgtccagcgcaacctccccttcgacaagcccaccatcatggccgccttcaccggcaacaccgagggccgcacctccgacatgcgcgccgagatcatccgcatgatggagggcgccaagcccgaggagatgtccttccagggccgcggcgtcttcgagctctccgacgagaaggccaccaaccccatcgtcccctccttcgacatgtccaacgagggctcctacttcttcggcgacaacgccgaggagtacgacaac

SEQ ID NO: 20632 - RNA, 1494 nt, synthetic construct
  misc_feature 1..1494: note = derived and/or modified sequence opt2 from anti-influenza_Chain
  source 1..1494: mol_type = other RNA
atggcctcccagggcaccaagcgctcctacgagcagatggagaccggcggcgagcgccagaacgccaccgagatccgcgcctccgtcggccgcatggtcggcggcatcggccgcttctacgtccagatgtgcaccgagctcaagctctccgaccaggagggccgcctcatccagaactccatcaccatcgagcgcatggtcctctccgccttcgacgagcgccgcaaccgctacctcgaggagcacccctccgccggcaaggaccccaagaagaccggcggccccatctaccgccgccgcgacggcaagtgggtccgcgagctcatcctctacgacaaggaggagatccgccgcatctggcgccaggccaacaacggcgaggacgccaccgccggcctcacccacatgatgatctggcactccaacctcaacgacgccacctaccagcgcacccgcgccctcgtccgcaccggcatggacccccgcatgtgctccctcatgcagggctccaccctcccccgccgctccggcgccgccggcgccgccatcaagggcgtcggcaccatggtcatggagctcatccgcatgatcaagcgcggcatcaacgaccgcaacttctggcgcggcgacaacggccgccgcacccgcatcgcctacgagcgcatgtgcaacatcctcaagggcaagttccagaccgccgcccagcgcgccatgatggaccaggtccgcgagtcccgcaaccccggcaacgccgagatcgaggacctcatcttcctcgcccgctccgccctcatcctccgcggctccgtcgcccacaagtcctgcctccccgcctgcgtctacggcctcgccgtcgcctccggctacgacttcgagcgcgagggctactccctcgtcggcatcgaccccttccgcctcctccagaactcccaggtcttctccctcatccgccccaacgagaaccccgcccacaagtcccagctcgtctggatggcctgccactccgccgccttcgaggacctccgcgtctcctccttcatccgcggcacccgcgtcatcccccgcggccagctctccacccgcggcgtccagatcgcctccaacgagaacgtcgaggccatggactcctccaccctcgagctccgctcccgctactgggccatccgcacccgctccggcggcaacaccaaccagcagcgcgcctccgccggccagatctccgtccagcccaccttctccgtccagcgcaacctccccttcgagcgccccaccatcatggccgccttcaagggcaacaccgagggccgcacctccgacatgcgcaccgagatcatccgcatgatggagtccgcccgccccgaggacgtctccttccagggccgcggcgtcttcgagctctccgacgagaaggccaccaaccccatcgtcccctccttcgacatgtccaacgagggctcctacttcttcggcgacaacgccgaggagtacgacaac

SEQ ID NO: 20633 - RNA, 1494 nt, synthetic construct; identical to SEQ ID NO: 20630
  misc_feature 1..1494: note = derived and/or modified sequence opt2 from anti-influenza_Chain
  source 1..1494: mol_type = other RNA

SEQ ID NO: 20634 - RNA, 1494 nt, synthetic construct; identical to SEQ ID NO: 20631
  misc_feature 1..1494: note = derived and/or modified sequence opt2 from anti-influenza_Chain
  source 1..1494: mol_type = other RNA

SEQ ID NO: 20635 - RNA, 1494 nt, synthetic construct; identical to SEQ ID NO: 20632
  misc_feature 1..1494: note = derived and/or modified sequence opt2 from anti-influenza_Chain
  source 1..1494: mol_type = other RNA

SEQ ID NO: 20636 - RNA, 1530 nt, synthetic construct
  misc_feature 1..1530: note = derived and/or modified sequence opt2 from anti-influenza_Chain
  source 1..1530: mol_type = other RNA
atgttccccgagaagttcctctggggcgtcgcccagtccggcttccagttcgagatgggcgacaagctccgccgcaacatcgacaccaacaccgactggtggcactgggtccgcgacaagaccaacatcgagaagggcctcgtctccggcgacctccccgaggagggcatcaacaactacgagctctacgagaaggaccacgagatcgcccgcaagctcggcctcaacgcctaccgcatcggcatcgagtggtcccgcatcttcccctggcccaccaccttcatcgacgtcgactactcctacaacgagtcctacaacctcatcgaggacgtcaagatcaccaaggacaccctcgaggagctcgacgagatcgccaacaagcgcgaggtcgcctactaccgctccgtcatcaactccctccgctccaagggcttcaaggtcatcgtcaacctcaaccacttcaccctcccctactggctccacgaccccatcgaggcccgcgagcgcgccctcaccaacaagcgcaacggctgggtcaacccccgcaccgtcatcgagttcgccaagtacgccgcctacatcgcctacaagttcggcgacatcgtcgacatgtggtccaccttcaacgagcccatggtcgtcgtcgagctcggctacctcgccccctactccggcttcccccccggcgtcctcaaccccgaggccgccaagctcgccatcctccacatgatcaacgcccacgccctcgcctaccgccagatcaagaagttcgacaccgagaaggccgacaaggactccaaggagcccgccgaggtcggcatcatctacaacaacatcggcgtcgcctaccccaaggaccccaacgactccaaggacgtcaaggccgccgagaacgacaacttcttccactccggcctcttcttcgaggccatccacaagggcaagctcaacatcgagttcgacggcgagaccttcatcgacgccccctacctcaagggcaacgactggatcggcgtcaactactacacccgcgaggtcgtcacctaccaggagcccatgttcccctccatccccctcatcaccttcaagggcgtccagggctacggctacgcctgccgccccggcaccctctccaaggacgaccgccccgtctccgacatcggctgggagctctaccccgagggcatgtacgactccatcgtcgaggcccacaagtacggcgtccccgtctacgtcaccgagaacggcatcgccgactccaaggacatcctccgcccctactacatcgcctcccacatcaagatgaccgagaaggccttcgaggacggctacgaggtcaagggctacttccactgggccctcaccgacaacttcgagtgggccctcggcttccgcatgcgcttcggcctctacgaggtcaacctcatcaccaaggagcgcatcccccgcgagaagtccgtctccatcttccgcgagatcgtcgccaacaacggcgtcaccaagaagatcgaggaggagctcctccgcggc

SEQ ID NO: 20637 - RNA, 1530 nt, synthetic construct; identical to SEQ ID NO: 20636
  misc_feature 1..1530: note = derived and/or modified sequence opt2 from anti-influenza_Chain
  source 1..1530: mol_type = other RNA

SEQ ID NO: 20638 - RNA, 1536 nt, synthetic construct
  misc_feature 1..1536: note = derived and/or modified sequence opt2 from anti-influenza_Chain
  source 1..1536: mol_type = other RNA
atgaagcgcaaggtcaagaagatggccgccatggccacctccatcatcatggccatcatgatcatcctccactccatccccgtcctcgccggccgcatcatctacgacaacgagaccggcacccacggcggctacgactacgagctctggaaggactacggcaacaccatcatggagctcaacgacggcggcaccttctcctgccagtggtccaacatcggcaacgccctcttccgcaagggccgcaagttcaactccgacaagacctaccaggagctcggcgacatcgtcgtcgagtacggctgcgactacaaccccaacggcaactcctacctctgcgtctacggctggacccgcaaccccctcgtcgagtactacatcgtcgagtcctggggctcctggcgcccccccggcgccacccccaagggcaccatcacccagtggatggccggcacctacgagatctacgagaccacccgcgtcaaccagccctccatcgacggcaccgccaccttccagcagtactggtccgtccgcacctccaagcgcacctccggcaccatctccgtcaccgagcacttcaagcagtgggagcgcatgggcatgcgcatgggcaagatgtacgaggtcgccctcaccgtcgagggctaccagtcctccggctacgccaacgtctacaagaacgagatccgcatcggcgccaaccccacccccgccccctcccagtcccccatccgccgcgacgccttctccatcatcgaggccgaggagtacaactccaccaactcctccaccctccaggtcatcggcacccccaacaacggccgcggcatcggctacatcgagaacggcaacaccgtcacctactccaacatcgacttcggctccggcgccaccggcttctccgccaccgtcgccaccgaggtcaacacctccatccagatccgctccgactcccccaccggcaccctcctcggcaccctctacgtctcctccaccggctcctggaacacctaccagaccgtctccaccaacatctccaagatcaccggcgtccacgacatcgtcctcgtcttctccggccccgtcaacgtcgacaacttcatcttctcccgctcctcccccgtccccgcccccggcgacaacacccgcgacgcctactccatcatccaggccgaggactacgactcctcctacggccccaacctccagatcttctccctccccggcggcggctccgccatcggctacatcgagaacggctactccaccacctacaagaacatcgacttcggcgacggcgccacctccgtcaccgcccgcgtcgccacccagaacgccaccaccatccaggtccgcctcggctccccctccggcaccctcctcggcaccatctacgtcggctccaccggctccttcgacacctaccgcgacgtctccgccaccatctccaacaccgccggcgtcaaggacatcgtcctcgtcttctccggccccgtcaacgtcgactggttcgtcttctccaagtccggcacc

SEQ ID NO: 20639 - RNA, 1536 nt, synthetic construct; identical to SEQ ID NO: 20638
  misc_feature 1..1536: note = derived and/or modified sequence opt2 from anti-influenza_Chain
  source 1..1536: mol_type = other RNA

SEQ ID NO: 20640 - RNA, 1539 nt, synthetic construct
  misc_feature 1..1539: note = derived and/or modified sequence opt2 from anti-influenza_Chain
  source 1..1539: mol_type = other RNA
atctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20641 - RNA, 1539 nt, synthetic construct; identical to SEQ ID NO: 20640
  misc_feature 1..1539: note = derived and/or modified sequence opt2 from anti-influenza_Chain
  source 1..1539: mol_type = other RNA

SEQ ID NO: 20642 - RNA, 1593 nt, synthetic construct
  misc_feature 1..1593: note = derived and/or modified sequence opt2 from anti-influenza_Chain
  source 1..1593: mol_type = other RNA
accctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacgcctacgtcttcgtcggcacctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcgacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaagatcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgcc

SEQ ID NO: 20643 - RNA, 1593 nt, synthetic construct
  misc_feature 1..1593: note = derived and/or modified sequence opt2 from anti-influenza_Chain
  source 1..1593: mol_type = other RNA
accctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctgcatcgtcgagacctcctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacgcctacgtcttcgtcggcacctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcgacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaagatcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgcc

SEQ ID NO: 20644 - RNA, 1593 nt, synthetic construct
  misc_feature 1..1593: note = derived and/or modified sequence opt2 from anti-influenza_Chain
  source 1..1593: mol_type = other RNA
accctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaacacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacgcctacgtcttcgtcggcacctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcgacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaagatcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgcc

SEQ ID NO: 20645 - RNA, 1593 nt, synthetic construct
  misc_feature 1..1593: note = derived and/or modified sequence opt2 from anti-influenza_Chain
  source 1..1593: mol_type = other RNA
accctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacgcctacgtcttcgtcggcacctcccgctactccaagaagttcggccccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcgacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaagatcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgcc

SEQ ID NO: 20646 - RNA, 1593 nt, synthetic construct; identical to SEQ ID NO: 20642
  misc_feature 1..1593: note = derived and/or modified sequence opt2 from anti-influenza_Chain
  source 1..1593: mol_type = other RNA

SEQ ID NO: 20647 - RNA, 1593 nt, synthetic construct; identical to SEQ ID NO: 20643
  misc_feature 1..1593: note = derived and/or modified sequence opt2 from anti-influenza_Chain
  source 1..1593: mol_type = other RNA

SEQ ID NO: 20648 - RNA, 1593 nt, synthetic construct; identical to SEQ ID NO: 20644
  misc_feature 1..1593: note = derived and/or modified sequence opt2 from anti-influenza_Chain
  source 1..1593: mol_type = other RNA

SEQ ID NO: 20649 - RNA, 1593 nt, synthetic construct; identical to SEQ ID NO: 20645
  misc_feature 1..1593: note = derived and/or modified sequence opt2 from anti-influenza_Chain
  source 1..1593: mol_type = other RNA

SEQ ID NO: 20650 - RNA, 1605 nt, synthetic construct
  misc_feature 1..1605: note = derived and/or modified sequence opt2 from anti-influenza_Chain
  source 1..1605: mol_type = other RNA
gccaacgccgacaccctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaagacctcctcctggcccgaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacgcctacgtcttcgtcggcacctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcaacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacaagatcaccaacaaggtcaactccgtcatcgagaagatgaacacccagttcaccgccgtcggcaaggagttcaaccacctcgagaagcgcatcgagaacctcaacaagaaggtcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgcc

SEQ ID NO: 20651 - RNA, 1605 nt, synthetic construct
  misc_feature 1..1605: note = derived and/or modified sequence opt2 from anti-influenza_Chain
  source 1..1605: mol_type = other RNA
gccaacgccgacaccctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccgcgccggcgccaagggcttctacaagaacctcatctggctcgtcaagaagggcaactcctaccccaagctcaacaagtcctacatcaacgacaagggcaaggaggtcctcgtcctctggggcatccaccacccctccaccaccgccgaccagcagtccctctaccagaacgccgacacctacgtcttcgtcggcacctcccgctactccaagaagttcaagcccgagatcgagatccgccccaaggtccgcgaccaggagggccgcatgaactactactggaccctcgtcgagcccggcgacaagatcaccttcgaggccaccggcaacctcgtcgtcccccgctacgccttcgccatggagcgcaacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacaagatcaccaacaaggtcaactccgtcatcgagaagatgaacacccagttcaccgccgtcgacaaggagttcaaccacctcgagaagcgcatcgagaacctcaacaagaaggtcgacgacggcttcctcgacatctggacctacaacgccgagctcctcgtcctcctcgagaacgagcgcaccctcgactaccacgactccaacgtcaagaacctctacgagaaggtccgcaaccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgcc

SEQ ID NO: 20652 - RNA, 1605 nt, synthetic construct; identical to SEQ ID NO: 20650
  misc_feature 1..1605: note = derived and/or modified sequence opt2 from anti-influenza_Chain
  source 1..1605: mol_type = other RNA

SEQ ID NO: 20653 - RNA, 1605 nt, synthetic construct; identical to SEQ ID NO: 20651
  misc_feature 1..1605: note = derived and/or modified sequence opt2 from anti-influenza_Chain
  source 1..1605: mol_type = other RNA

SEQ ID NO: 20654 - RNA, 1644 nt, synthetic construct
  misc_feature 1..1644: note = derived and/or modified sequence opt2 from anti-influenza_Chain
  source 1..1644: mol_type = other RNA
cagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcgagatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacaacgagtccttcaactggaccggcgtcacccagaacggcacctcctccgcctgcatccgccgctccaacaactccttcttctcccgcctcaactggctcacccacctcaagttcaagtaccccgccctcaacgtcaccatgcccaacaacgagaagttcgacaagctctacatctggggcgtccaccaccccggcaccgacaacgaccagatcttcccctacgcccaggcctccggccgcatcaccgtctccaccaagcgctcccagcagaccgtcatccccaacatcggctcccgcccccgcgtccgcaacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcatcggccaggccgccgacctcaagtccacccaggccgccatcgaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagaagaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatc

SEQ ID NO: 20655 - RNA, 1644 nt, synthetic construct; identical to SEQ ID NO: 20654
  misc_feature 1..1644: note = derived and/or modified sequence opt2 from anti-influenza_Chain
  source 1..1644: mol_type = other RNA

SEQ ID NO: 20656 - RNA, 1647 nt, synthetic construct
  misc_feature 1..1647: note = derived and/or modified sequence opt2 from anti-influenza_Chain
  source 1..1647: mol_type = other RNA
atgctcaccttccaccgcatcatccgcaagggctggatgttcctcctcgccttcctcctcaccgccctcctcttctgccccaccggccagcccgccaaggccgccgcccccttcaacggcaccatgatgcagtacttcgagtggtacctccccgacgacggcaccctctggaccaaggtcgccaacgaggccaacaacctctcctccctcggcatcaccgccctctggctcccccccgcctacaagggcacctcccgctccgacgtcggctacggcgtctacgacctctacgacctcggcgagttcaaccagaagggcgccgtccgcaccaagtacggcaccaaggcccagtacctccaggccatccaggccgcccacgccgccggcatgcaggtctacgccgacgtcgtcttcgaccacaagggcggcgccgacggcaccgagtgggtcgacgccgtcgaggtcaacccctccgaccgcaaccaggagatctccggcacctaccagatccaggcctggaccaagttcgacttccccggccgcggcaacacctactcctccttcaagtggcgctggtaccacttcgacggcgtcgactgggacgagtcccgcaagctctcccgcatctacaagttccgcggcatcggcaaggcctgggactgggaggtcgacaccgagaacggcaactacgactacctcatgtacgccgacctcgacatggaccaccccgaggtcgtcaccgagctcaagtcctggggcaagtggtacgtcaacaccaccaacatcgacggcttccgcctcgacgccgtcaagcacatcaagttctccttcttccccgactggctctccgacgtccgctcccagaccggcaagcccctcttcaccgtcggcgagtactggtcctacgacatcaacaagctccacaactacatcatgaagaccaacggcaccatgtccctcttcgacgcccccctccacaacaagttctacaccgcctccaagtccggcggcaccttcgacatgcgcaccctcatgaccaacaccctcatgaaggaccagcccaccctcgccgtcaccttcgtcgacaaccacgacaccgagcccggccaggccctccagtcctgggtcgacccctggttcaagcccctcgcctacgccttcatcctcacccgccaggagggctacccctgcgtcttctacggcgactactacggcatcccccagtacaacatcccctccctcaagtccaagatcgaccccctcctcatcgcccgccgcgactacgcctacggcacccagcacgactacctcgaccactccgacatcatcggctggacccgcgagggcgtcaccgagaagcccggctccggcctcgccgccctcatcaccgacggccccggcggctccaagtggatgtacgtcggcaagcagcacgccggcaaggtcttctacgacctcaccggcaaccgctccgacaccgtcaccatcaactccgacggctggggcgagttcaaggtcaacggcggctccgtctccgtctgggtcccccgcaagaccaccgtctccaccatcgcctggtccatcaccacccgcccctggaccgacgagttcgtccgctggaccgagccccgcctcgtcgcctggccc

SEQ ID NO: 20657 - RNA, 1647 nt, synthetic construct
  misc_feature 1..1647: note = derived and/or modified sequence opt2 from anti-influenza_Chain
  source 1..1647: mol_type = other RNA
atctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20658 - RNA, 1647 nt, synthetic construct; identical to SEQ ID NO: 20657
  misc_feature 1..1647: note = derived and/or modified sequence opt2 from anti-influenza_Chain
  source 1..1647: mol_type = other RNA

SEQ ID NO: 20659 - RNA, 1647 nt, synthetic construct; identical to SEQ ID NO: 20656
  misc_feature 1..1647: note = derived and/or modified sequence opt2 from anti-influenza_Chain
  source 1..1647: mol_type = other RNA

SEQ ID NO: 20660 - RNA, 1650 nt, synthetic construct
  misc_feature 1..1650: note = derived and/or modified sequence opt2 from anti-influenza_Chain
  source 1..1650: mol_type = other RNA
gaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccaccaacgacctctgctaccccggctccttcaacgactacgaggagctcaagcacctcctctcccgcatcaaccacttcgagaagatccagatcatccccaagtcctcctggtccgaccacgaggcctcctccggcgtctcctccgcctgcccctacctcggctccccctccttcttccgcaacgtcgtctggctcatcaagaagaactccacctaccccaccatcaagaagtcctacaacaacaccaaccaggaggacctcctcgtcctctggggcatccaccaccccaacgacgccgccgagcagacccgcctctaccagaaccccaccacctacatctccatcggcacctccaccctcaaccagcgcctcgtccccaagatcgccacccgctccaaggtcaacggccagtccggccgcatggagttcttctgggccatcctcaagcccaacgacgccatcaacttcgagtccaacggcaacttcatcgcccccgagtacgcctacaagatcgtcaagaagggcgactccgccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagtcccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccatccgcaacggcacctacaacccccagtactccgaggaggcccgcctcaagcgcgaggagatctccggcgtcaagctcgagtccatcggcacctaccagatcctctccatctactccaccgtcgcctcctccctcgccctcgccatcatgatcgccggcctctccctctggatgtgctccaacggctccctccagtgccgcatctgcatc

SEQ ID NO: 20661 - RNA, 1650 nt, synthetic construct; identical to SEQ ID NO: 20660
  misc_feature 1..1650: note = derived and/or modified sequence opt2 from anti-influenza_Chain
  source 1..1650: mol_type = other RNA

SEQ ID NO: 20662 - RNA, 1656 nt, synthetic construct
  misc_feature 1..1656: note = derived and/or modified sequence opt2 from anti-influenza_Chain
  source 1..1656: mol_type = other RNA
atgaacatccagatcctcgccttcatcgcctgcgtcctcaccggcgccaagggcgacaagatctgcctcggccaccacgccgtcgccaacggcaccaaggtcaacaccctcaccgagaagggcatcgaggtcgtcaacgccaccgagaccgtcgagaccgccgacgtcaagaagatctgcacccagggcaagcgcgccaccgacctcggccgctgcggcctcctcggcaccctcatcggccccccccagtgcgaccagttcctcgagttctcctccgacctcatcatcgagcgccgcgagggcaccgacgtctgctaccccggccgcttcaccaacgaggagtccctccgccagatcctccgccgctccggcggcatcggcaaggagtccatgggcttcacctactccggcatccgcaccaacggcgccgcctccgcctgcacccgctccggctcctccttctacgccgagatgaagtggctcctctccaactccgacaactccgccttcccccagatgaccaaggcctaccgcaacccccgcaacaagcccgccctcatcatctggggcgtccaccactccgagtccgcctccgagcagaccaagctctacggctccggcaacaagctcatcaccgtccgctcctccaagtaccagcagtccttcaccccctcccccggcacccgccgcatcgacttccactggctcctcctcgaccccaacgacaccgtcaccttcaccttcaacggcgccttcatcgcccccgaccgcgcctccttcttccgcggcgagtccctcggcgtccagtccgacgcccccctcgactcctcctgccgcggcgactgcttccactccggcggcaccatcgtctcctccctccccttccagaacatcaactcccgcaccgtcggccgctgcccccgctacgtcaagcagaagtccctcctcctcgccaccggcatgcgcaacgtccccgagaagcccaagccccgcggcctcttcggcgccatcgccggcttcatcgagaacggctgggagggcctcatcaacggctggtacggcttccgccaccagaacgcccagggcgagggcaccgccgccgactacaagtccacccagtccgccatcgaccagatcaccggcaagctcaaccgcctcatcggcaagaccaaccagcagttcgagctcatcgacaacgagttcaacgagatcgagcagcagatcggcaacgtcatcaactggacccgcgacgccatgaccgagatctggtcctacaacgccgagctcctcgtcgccatggagaaccagcacaccatcgacctcgccgactccgagatgtccaagctctacgagcgcgtcaagaagcagctccgcgagaacgccgaggaggacggcaccggctgcttcgagatcttccacaagtgcgacgaccagtgcatggagtccatccgcaacaacacctacgaccacacccagtaccgcaccgagtccctccagaaccgcatccagatcgaccccgtcaagctctcctccggctacaaggacatcatcctctggttctccttcggcgcctcctgcttcatcctcctcgccatcgccatgggcctcgtcttcatctgcatcaagaacggcaacatgcagtgcaccatctgcatc

SEQ ID NO: 20663 - RNA, 1656 nt, synthetic construct
  misc_feature 1..1656: note = derived and/or modified sequence opt2 from anti-influenza_Chain
  source 1..1656: mol_type = other RNA
atgaacacccagatcctcgccttcatcgcctgcgtcctcaccggcgtcaagggcgacaagatctgcctcggccaccacgccgtcgccaacggcaccaaggtcaacaccctcaccgagaagggcatcgaggtcgtcaacgccaccgagaccgtcgagaccgccgacgtcaagaagatctgcacccagggcaagcgcgccaccgacctcggccgctgcggcctcctcggcaccctcatcggccccccccagtgcgaccagttcctcgagttctcctccgacctcatcatcgagcgccgcgagggcaccgacgtctgctaccccggccgcttcaccaacgaggagtccctccgccagatcctccgccgctccggcggcatcggcaaggagtccatgggcttcacctactccggcatccgcaccaacggcgccacctccgcctgcacccgctccggctcctccttctacgccgagatgaagtggctcctctccaactccgacaactccgccttcccccagatgaccaaggcctaccgcaacccccgcaacaagcccgccctcatcatctggggcgtccaccactccgagtccgtctccgagcagaccaagctctacggctccggcaacaagctcatcaccgtccgctcctccaagtaccagcagtccttcaccccctcccccggcgcccgccgcatcgacttccactggctcctcctcgaccccaacgacaccgtcaccttcaccttcaacggcgccttcatcgcccccgaccgcgcctccttcttccgcggcgagtccctcggcgtccagtccgacgtccccctcgactcctcctgccgcggcgactgcttccactccggcggcaccatcgtctcctccctccccttccagaacatcaactcccgcaccgtcggcaagtgcccccgctacgtcaagcagaagtccctcctcctcgccaccggcatgcgcaacgtccccgagaagcccaagccccgcggcctcttcggcgccatcgccggcttcatcgagaacggctgggagggcctcatcaacggctggtacggcttccgccaccagaacgcccagggcgagggcaccgccgccgactacaagtccacccagtccgccatcgaccagatcaccggcaagctcaaccgcctcatcggcaagaccaaccagcagttcgagctcatcgacaacgagttcaacgagatcgagcagcagatcggcaacgtcatcaactggacccgcgacgccatgaccgagatctggtcctacaacgccgagctcctcgtcgccatggagaaccagcacaccatcgacctcgccgactccgagatgtccaagctctacgagcgcgtcaagaagcagctccgcgagaacgccgaggaggacggcaccggctgcttcgagatcttccacaagtgcgacgaccagtgcatggagtccatccgcaacaacacctacgaccacacccagtaccgcaccgagtccctccagaaccgcatccagatcgaccccgtcaagctctcctccggctacaaggacatcatcctctggttctccttcggcgcctcctgcttcctcctcctcgccatcgccatgggcctcgtcttcatctgcatcaagaacggcaacatgcagtgcaccatctgcatc

SEQ ID NO: 20664 - RNA, 1656 nt, synthetic construct
  misc_feature 1..1656: note = derived and/or modified sequence opt2 from anti-influenza_Chain
  source 1..1656: mol_type = other RNA
atgaacatccagatcctcgccttcatcgcctgcgtcctcaccggcgccaagggcgacaagatctgcctcggccaccacgccgtcgccaacggcaccaaggtcaacaccctcaccgagaagggcatcgaggtcgtcaacgccaccgagaccgtcgagaccgccaacatcaagaagatctgcacccagggcaagcgccccaccgacctcggccagtgcggcctcctcggcaccctcatcggccccccccagtgcgaccagttcctcgagttctcctccgacctcatcatcgagcgccgcgagggcaccgacgtctgctaccccggcaagttcaccaacgaggagtccctccgccagatcctccgccgctccggcggcatcggcaaggagtccatgggcttcacctactccggcatccgcaccaacggcgccacctccgcctgcacccgctccggctcctccttctacgccgagatgaagtggctcctctccaactccgacaacgccgccttcccccagatgaccaagtcctaccgcaacccccgcaacaagcccgccctcatcatctggggcgtccaccactccgagtccgtctccgagcagaccaagctctacggctccggcaacaagctcatcaaggtccgctcctccaagtaccagcagtccttcacccccaaccccggcgcccgccgcatcgacttccactggctcctcctcgaccccaacgacaccgtcaccttcaccttcaacggcgccttcatcgcccccgaccgcgcctccttcttccgcggcgagtccatcggcgtccagtccgacgcccccctcgactcctcctgcggcggcaactgcttccacaacggcggcaccatcgtctcctccctccccttccagaacatcaacccccgcaccgtcggcaagtgcccccgctacgtcaagcagaagtccctcctcctcgccaccggcatgcgcaacgtccccgagaagcccaagaagcgcggcctcttcggcgccatcgccggcttcatcgagaacggctgggagggcctcatcaacggctggtacggcttccgccaccagaacgcccagggcgagggcaccgccgccgactacaagtccacccagtccgccatcgaccagatcaccggcaagctcaaccgcctcatcggcaagaccaaccagcagttcgagctcatcaacaacgagttcaacgaggtcgagcagcagatcggcaacgtcatcaactggacccaggacgccatgaccgaggtctggtcctacaacgccgagctcctcgtcgccatggagaaccagcacaccatcgacctcaccgactccgagatgtccaagctctacgagcgcgtccgcaagcagctccgcgagaacgccgaggaggacggcaccggctgcttcgagatcttccacaagtgcgacgaccactgcatggagtccatccgcaacaacacctacgaccacacccagtaccgcaccgagtccctccagaaccgcatccagatcgaccccgtcaagctctccggcggctacaaggacatcatcctctggttctccttcggcgcctcctgcttcctcctcctcgccatcgccatgggcctcgtcttcatctgcatcaagaacggcaacatgcagtgcaccatctgcatc

SEQ ID NO: 20665 - RNA, 1656 nt, synthetic construct
  misc_feature 1..1656: note = derived and/or modified sequence opt2 from anti-influenza_Chain
  source 1..1656: mol_type = other RNA
gaccagatctgcatcggctaccacgccaacaactccaccgagcaggtcgacaccatcatggagaagaacgtcaccgtcacccacgcccagaacatcctcgagaagacccacaacggcaagctctgcgacctcgacggcgtcaagcccctcatcctccgcgactgctccgtcgccggctggctcctcggcaaccccatgtgcgacgagttcctcaacgtccccgagtggtcctacatcgtcgagaagatcaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggccgctcctccttcttccgcaacgtcgtctggctcatcaagaaggacaacgcctaccccaccatcaagcgctcctacaacaacaccaaccaggaggacctcctcgtcctctggggcatccaccaccccaacgacgccgccgagcagacccgcctctaccagaaccccaccacctacatctccgtcggcacctccaccctcaaccagcgcctcgtccccaagatcgccacccgctccaaggtcaacggccagtccggccgcatggagttcttctggaccatcctcaagcccaacgacgccatcaacttcgagtccaacggcaacttcatcgcccccgagaacgcctacaagatcgtcaagaagggcgactccaccatcatgaagtccgagctcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactccccccagggcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaagatccgcctccagctccgcgacaacgccaaggagctcggcaacggctgcttcgagttctaccaccgctgcgacaacgagtgcatggagtccgtccgcaacggcacctacgactacccccagtactccgaggaggcccgcctcaagcgcgaggagatctccggcgtcaagctcgagtccatcggcacctaccagatcctctccatctactccaccgtcgcctcctccctcaccctcgccatcatggtcgccggcctctccctctggatgtgctccaacggctccctccagtgccgcatctgcatc

SEQ ID NO: 20666 - RNA, 1656 nt, synthetic construct
  misc_feature 1..1656: note = derived and/or modified sequence opt2 from anti-influenza_Chain
  source 1..1656: mol_type = other RNA
gaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccaccaacgacctctgctaccccggctccttcaacgactacgaggagctcaagcacctcctctcccgcatcaaccacttcgagaagatccagatcatccccaagtcctcctggtccgaccacgaggcctcctccggcgtctcctccgcctgcccctacctcggctccccctccttcttccgcaacgtcgtctggctcatcaagaagaactccacctaccccaccatcaagaagtcctacaacaacaccaaccaggaggacctcctcgtcctctggggcatccaccaccccaacgacgccgccgagcagacccgcctctaccagaaccccaccacctacatctccatcggcacctccaccctcaaccagcgcctcgtccccaagatcgccacccgctccaaggtcaacggccagtccggccgcatggagttcttctggaccatcctcaaccccaacgacgccatcaacttcgagtccaacggcaacttcatcgcccccgagtacgcctacaagatcgtcaagaagggcgactccgccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagtcccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccatccgcaacggcacctacaactacccccagtactccgaggaggcccgcctcaagcgcgaggagatctccggcgtcaagctcgagtccatcggcacctaccagatcctctccatctactccaccgtcgcctcctccctcgccctcgccatcatgatggccggcctctccctctggatgtgctccaacggctccctccagtgccgcatctgcatc

SEQ ID NO: 20667 - RNA, 1656 nt, synthetic construct; identical to SEQ ID NO: 20662
  misc_feature 1..1656: note = derived and/or modified sequence opt2 from anti-influenza_Chain
  source 1..1656: mol_type = other RNA

SEQ ID NO: 20668 - RNA, 1656 nt, synthetic construct; identical to SEQ ID NO: 20663
  misc_feature 1..1656: note = derived and/or modified sequence opt2 from anti-influenza_Chain
  source 1..1656: mol_type = other RNA

SEQ ID NO: 20669 - RNA, 1656 nt, synthetic construct; identical to SEQ ID NO: 20664
  misc_feature 1..1656: note = derived and/or modified sequence opt2 from anti-influenza_Chain
  source 1..1656: mol_type = other RNA

SEQ ID NO: 20670 - RNA, 1656 nt, synthetic construct; identical to SEQ ID NO: 20665
  misc_feature 1..1656: note = derived and/or modified sequence opt2 from anti-influenza_Chain
  source 1..1656: mol_type = other RNA

SEQ ID NO: 20671 - RNA, 1656 nt, synthetic construct; identical to SEQ ID NO: 20666
  misc_feature 1..1656: note = derived and/or modified sequence opt2 from anti-influenza_Chain
  source 1..1656: mol_type = other RNA

SEQ ID NO: 20672 - RNA, 1680 nt, synthetic construct
  misc_feature 1..1680: note = derived and/or modified sequence opt2 from anti-influenza_Chain
  source 1..1680: mol_type = other RNA
atgtccaacatggacatcgactccatcaacaccggcaccatcgacaagacccccgaggagctcacccccggcacctccggcgccacccgccccatcatcaagcccgccaccctcgcccccccctccaacaagcgcacccgcaacccctcccccgagcgcaccaccacctcctccgagaccgacatcggccgcaagatccagaagaagcagacccccaccgagatcaagaagtccgtctacaagatggtcgtcaagctcggcgagttctacaaccagatgatggtcaaggccggcctcaacgacgacatggagcgcaacctcatccagaacgcccaggccgtcgagcgcatcctcctcgccgccaccgacgacaagaagaccgagtaccagaagaagcgcaacgcccgcgacgtcaaggagggcaaggaggagatcgaccacaacaagaccggcggcaccttctacaagatggtccgcgacgacaagaccatctacttctcccccatcaagatcaccttcctcaaggaggaggtcaagaccatgtacaagaccaccatgggctccgacggcttctccggcctcaaccacatcatgatcggccactcccagatgaacgacgtctgcttccagcgctccaagggcctcaagcgcgtcggcctcgacccctccctcatctccaccttcgccggctccaccctcccccgccgctccggcaccaccggcgtcgccatcaagggcggcggcaccctcgtcgacgaggccatccgcttcatcggccgcgccatggccgaccgcggcctcctccgcgacatcaaggccaagaccgcctacgagaagatcctcctcaacctcaagaacaagtgctccgccccccagcagaaggccctcgtcgaccaggtcatcggctcccgcaaccccggcatcgccgacatcgaggacctcaccctcctcgcccgctccatggtcgtcgtccgcccctccgtcgcctccaaggtcgtcctccccatctccatctacgccaagatcccccagctcggcttcaacaccgaggagtactccatggtcggctacgaggccatggccctctacaacatggccacccccgtctccatcctccgcatgggcgacgacgccaaggacaagtcccagctcttcttcatgtcctgcttcggcgccgcctacgaggacctccgcgtcctctccgccctcaccggcaccgagttcaagccccgctccgccctcaagtgcaagggcttccacgtccccgccaaggagcaggtcgagggcatgggcgccgccctcatgtccatcaagctccagttctgggcccccatgacccgctccggcggcaacgaggtctccggcgagggcggctccggccagatctcctgctcccccgtcttcgccgtcgagcgccccatcgccctctccaagcaggccgtccgccgcatgctctccatgaacgtcgagggccgcgacgccgacgtcaagggcaacctcctcaagatgatgaacgactccatggccaagaagacctccggcaacgccttcatcggcaagaagatgttccagatctccgacaagaacaaggtcaaccccatcgagatccccatcaagcagaccatccccaacttcttcttcggccgcgacaccgccgaggactacgacgacctcgactac

SEQ ID NO: 20673 - RNA, 1680 nt, synthetic construct
  misc_feature 1..1680: note = derived and/or modified sequence opt2 from anti-influenza_Chain
  source 1..1680: mol_type = other RNA
atgaacacccagatcctcgccctcatcgcctacatgctcatcggcgccaagggcgacaagatctgcctcggccaccacgccgtcgccaacggcaccaaggtcaacaccctcaccgagcgcggcatcgaggtcgtcaacgccaccgagaccgtcgagaccgtcaacatcaagaagatctgcacccagggcaagcgccccaccgacctcggccagtgcggcctcctcggcaccctcatcggccccccccagtgcgaccagttcctcgagttcgacgccgacctcatcatcgagcgccgcgagggcaccgacgtctgctaccccggcaagttcaccaacgaggagtccctccgccagatcctccgcggctccggcggcatcgacaaggagtccatgggcttcacctactccggcatccgcaccaacggcgtcacctccgcctgccgccgctccggctcctccttctacgccgagatgaagtggctcctctccaactccgacaacgccgccttcccccagatgaccaagtcctaccgcaacccccgcaacaagcccgccctcatcatctggggcgtccaccactccggctccgccaccgagcagaccaagctctacggctccggcaacaagctcatcaccgtcggctcctccaagtaccagcagtccttcaccccctcccccggcgcccgcccccaggtcaacggccagtccggccgcatcgacttccactggctcctcctcgaccccaacgacaccgtcaccttcaccttcaacggcgccttcatcgcccccgaccgcgcctccttcttccgcggcgagtccctcggcgtccagtccgacgtccccctcgactccggctgcgagggcgactgcttccactcccgcggcaccatcgtctcctccctccccttccagaacatcaacccccgcaccgtcggcaagtgcccccgctacgtcaagcagacctccctcctcctcgccaccggcatgcgcaacgtccccgagaaccccaagacccgcggcctcttcggcgccatcgccggcttcatcgagaacggctgggagggcctcatcgacggctggtacggcttccgccaccagaacgcccagggcgagggcaccgccgccgactacaagtccacccagtccgccatcgaccagatcaccggcaagctcaaccgcctcatcgacaagaccaaccagcagttcgagctcatcgacaacgagttctccgagatcgagcagcagatcggcaacgtcatcaactggacccgcgactccatgaccgaggtctggtcctacaacgccgagctcctcgtcgccatggagaaccagcacaccatcgacctcgccgactccgagatgaacaagctctacgagcgcgtccgcaagcagctccgcgagaacgccgaggaggacggcaccggctgcttcgagatcttccacaagtgcgacgaccagtgcatggagtccatccgcaacaacacctacgaccacacccagtaccgcaccgagtccctccagaaccgcatccagatcgaccccgtcaagctctcctccggctacaaggacatcatcctctggttctccttcggcgcctcctgcttcctcctcctcgccatcgccatgggcctcgtcttcatctgcatcaagaacggcaacatgcgctgcaccatctgcatc

SEQ ID NO: 20674 - RNA, 1680 nt, synthetic construct
  misc_feature 1..1680: note = derived and/or modified sequence opt2 from anti-influenza_Chain
  source 1..1680: mol_type = other RNA
atgaacacccagatcctcgccctcatcgcctgcatgctcatcggcgccaagggcgacaagatctgcctcggccaccacgccgtcgccaacggcaccaaggtcaacaccctcaccgagcgcggcatcgaggtcgtcaacgccaccgagaccgtcgagaccgccaacatcaagaagatctgcacccagggcaagcgccccaccgacctcggccagtgcggcctcctcggcaccctcatcggccccccccagtgcgaccagttcctcgagttcgacgccgacctcatcatcgagcgccgcgagggcaccgacgtctgctaccccggcaagttcaccaacgaggagtccctccgccagatcctccgcggctccggcggcatcgacaaggagtccatgggcttcacctactccggcatccgcaccaacggcgccacctccgcctgccgccgctccggctcctccttctacgccgagatgaagtggctcctctccaactccgacaacgccgccttcccccagatgaccaagtcctaccgcaacccccgcaacaagcccgccctcatcatctggggcgtccaccactccggctccgccaccgagcagaccaagctctacggctccggcaacaagctcatcaccgtcggctcctccaagtaccagcagtccttcaccccctcccccggcgcccgcccccaggtcaacggccagtccggccgcatcgacttccactggctcctcctcgaccccaacgacaccgtcaccttcaccttcaacggcgccttcatcgcccccgaccgcgcctccttcttccgcggcggctccctcggcgtccagtccgacgtccccctcgactccggctgcgagggcgactgcttccactccggcggcaccatcgtctcctccctccccttccagaacatcaacccccgcaccgtcggcaagtgcccccgctacgtcaagcagacctccctcctcctcgccaccggcatgcgcaacgtccccgagaaccccaagacccgcggcctcttcggcgccatcgccggcttcatcgagaacggctgggagggcctcatcgacggctggtacggcttccgccaccagaacgcccagggcgagggcaccgccgccgactacaagtccacccagtccgccatcgaccagatcaccggcaagctcaaccgcctcatcgacaagaccaaccagcagttcgagctcatcgacaacgagttcaacgagatcgagcagcagatcggcaacgtcatcaactggacccgcgactccatgaccgaggtctggtcctacaacgccgagctcctcgtcgccatggagaaccagcacaccatcgacctcgccgactccgagatgaacaagctctacgagcgcgtccgcaagcagctccgcgagaacgccgaggaggacggcaccggctgcttcgagatcttccacaagtgcgacgaccagtgcatggagtccatccgcaacaacacctacgaccacacccagtaccgcaccgagtccctccagaaccgcatccagatcaaccccgtcaagctctcctccggctacaaggacatcatcctctggttctccttcggcgcctcctgcttcctcctcctcgccatcgccatgggcctcgtcttcatctgcatcaagaacggcaacatgcgctgcaccatctgcatc

SEQ ID NO: 20675 - RNA, 1680 nt, synthetic construct
  misc_feature 1..1680: note = derived and/or modified sequence opt2 from anti-influenza_Chain
  source 1..1680: mol_type = other RNA
atggagcgcatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcctcaacgtccccgagtggtcctacatcgtcgagaagatcaaccccgccaacgacctctgctaccccggcaacttcaacgactacgaggagctcaagcacctcctctcccgcatcaaccacttcgagcgcatccagatcatccccaagtcctcctggtccgaccacgaggcctcctccggcgtctcctccgcctgcccctaccagggccgctcctccttcttccgcaacgtcgtctggctcatcaagaagaacaacgcctaccccaccatcaagcgctcctacaacaacaccaaccaggaggacctcctcgtcctctggggcatccaccaccccaacgacgccgccgagcagacccgcctctaccagaaccccaccacctacatctccgtcggcacctccaccctcaaccagcgcctcgtccccaagatcgccacccgctccaaggtcaacggccagtccggccgcatggagttcttctggaccatcctcaagcccaacgacgccatcaacttcgagtccaacggcaacttcatcgcccccgagaacgcctacaagaactgccagaagggcgactccaccatcatgaagtccgagctcgagtacggcaactgcaacaccaagtgccagacccccatcggcgccatcaactcctccatgcccttccacaacatccaccccctcaccatcggcgagtgccccaagtacgtcaagtccaaccgcctcgtcctcgccaccggcctccgcaactccccccagggcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccaccgctgcgacaacgagtgcatggagtccgtccgcaacggcacctacgactacccccagtactccgaggaggcccgcctcaagcgcgaggagatctccggcgtcaagctcgagtccatcggcacctaccagatcctctccatctactccaccgtcgcctcctccctcgccctcgccatcatggtcgccggcctctccctctggatgtgctccaacggc

SEQ ID NO: 20676 - RNA, 1680 nt, synthetic construct; identical to SEQ ID NO: 20672
  misc_feature 1..1680: note = derived and/or modified sequence opt2 from anti-influenza_Chain
  source 1..1680: mol_type = other RNA

SEQ ID NO: 20677 - RNA, 1680 nt, synthetic construct; identical to SEQ ID NO: 20673
  misc_feature 1..1680: note = derived and/or modified sequence opt2 from anti-influenza_Chain
  source 1..1680: mol_type = other RNA

SEQ ID NO: 20678 - RNA, 1680 nt, synthetic construct; identical to SEQ ID NO: 20674
  misc_feature 1..1680: note = derived and/or modified sequence opt2 from anti-influenza_Chain
  source 1..1680: mol_type = other RNA

SEQ ID NO: 20679 - RNA, 1680 nt, synthetic construct; identical to SEQ ID NO: 20675
  misc_feature 1..1680: note = derived and/or modified sequence opt2 from anti-influenza_Chain
  source 1..1680: mol_type = other RNA

SEQ ID NO: 20680 - RNA, 1686 nt, synthetic construct
  misc_feature 1..1686: note = derived and/or modified sequence opt2 from anti-influenza_Chain
  source 1..1686: mol_type = other RNA
atgccccgcgccctccgccgcgtccccggctcccgcgtcatgctccgcgtcggcgtcgtcgtcgccgtcctcgccctcgtcgccgccctcgccaacctcgccgtcccccgccccgcccgcgccgccggcggcggctactggcacacctccggccgcgagatcctcgacgccaacaacgtccccgtccgcatcgccggcatcaactggttcggcttcgagacctgcaactacgtcgtccacggcctctggtcccgcgactaccgctccatgctcgaccagatcaagtccctcggctacaacaccatccgcctcccctactccgacgacatcctcaagcccggcaccatgcccaactccatcaacttctaccagatgaaccaggacctccagggcctcacctccctccaggtcatggacaagatcgtcgcctacgccggccagatcggcctccgcatcatcctcgaccgccaccgccccgactgctccggccagtccgccctctggtacacctcctccgtctccgaggccacctggatctccgacctccaggccctcgcccagcgctacaagggcaaccccaccgtcgtcggcttcgacctccacaacgagccccacgaccccgcctgctggggctgcggcgacccctccatcgactggcgcctcgccgccgagcgcgccggcaacgccgtcctctccgtcaaccccaacctcctcatcttcgtcgagggcgtccagtcctacaacggcgactcctactggtggggcggcaacctccagggcgccggccagtaccccgtcgtcctcaacgtccccaaccgcctcgtctactccgcccacgactacgccacctccgtctacccccagacctggttctccgaccccaccttccccaacaacatgcccggcatctggaacaagaactggggctacctcttcaaccagaacatcgcccccgtctggctcggcgagttcggcaccaccctccagtccaccaccgaccagacctggctcaagaccctcgtccagtacctccgccccaccgcccagtacggcgccgactccttccagtggaccttctggtcctggaaccccgactccggcgacaccggcggcatcctcaaggacgactggcagaccgtcgacaccgtcaaggacggctacctcgcccccatcaagtcctccatcttcgaccccgtcggcgcctccgcctccccctcctcccagccctccccctccgtctccccctccccctccccctccccctccgcctcccgcacccccacccccacccccacccccaccgcctcccccacccccaccctcacccccaccgccacccccacccccaccgcctcccccaccccctcccccaccgccgcctccggcgcccgctgcaccgcctcctaccaggtcaactccgactggggcaacggcttcaccgtcaccgtcgccgtcaccaactccggctccgtcgccaccaagacctggaccgtctcctggaccttcggcggcaaccagaccatcaccaactcctggaacgccgccgtcacccagaacggccagtccgtcaccgcccgcaacatgtcctacaacaacgtcatccagcccggccagaacaccaccttcggcttccaggcctcctacaccggctccaacgccgcccccaccgtcgcctgcgccgcctcc

SEQ ID NO: 20681 - RNA, 1686 nt, synthetic construct
  misc_feature 1..1686: note = derived and/or modified sequence opt2 from anti-influenza_Chain
  source 1..1686: mol_type = other RNA
atggagcgcgtctggtggaaggaggccgtcgtctaccagatctacccccgctccttctacgactccaacggcgacggcatcggcgacatccgcggcatcatcgccaagctcgactacctcaaggagctcggcgtcgacgtcgtctggctctcccccgtctacaagtcccccaacgacgacaacggctacgacatctccgactaccgcgacatcatggacgagttcggcaccatggccgactggaagaccatgctcgaggagatgcacaagcgcggcatcaagctcgtcatggacctcgtcgtcaaccacacctccgacgagcacccctggttcatcgagtcccgcaagtccaaggacaacccctaccgcgactactacatctggcgccccggcaagaacggcaaggagcccaacaactgggagtccgtcttctccggctccgcctgggagtacgacgagatgaccggcgagtactacctccacctcttctccaagaagcagcccgacctcaactgggagaaccccaaggtccgccgcgaggtctacgagatgatgaagttctggctcgacaagggcgtcgacggcttccgcatggacgtcatcaacatgatctccaaggtccccgagctccccgacggcgagccccagtccggcaagaagtacgcctccggctcccgctactacatgaacggcccccgcgtccacgagttcctccaggagatgaaccgcgaggtcctctccaagtacgacatcatgaccgtcggcgagacccccggcgtcacccccaaggagggcatcctctacaccgacccctcccgccgcgagctcaacatggtcttccagttcgagcacatggacctcgactccggccccggcggcaagtgggacatccgcccctggtccctcgccgacctcaagaagaccatgaccaagtggcagaaggagctcgagggcaagggctggaactccctctacctcaacaaccacgaccagccccgcgccgtctcccgcttcggcgacgacggcaagtaccgcgtcgagtccgccaagatgctcgccaccttcctccacatgatgcagggcaccccctacatctaccagggcgaggagatcggcatgaccaacgtccgcttcccctccatcgaggactaccgcgacatcgagaccctcaacatgtacaaggagcgcgtcgaggagtacggcgaggacccccaggaggtcatggagaagatctactacaagggccgcgacaacgcccgcacccccatgcagtgggacgactccgagaacgccggcttcaccgccggcaccccctggatccccgtcaaccccaactacaaggagatcaacgtcaaggccgccctcgaggaccccaactccgtcttccactactacaagaagctcatccagctccgcaagcagcacgacatcatcgtctacggcacctacgacctcatcctcgaggacgacccctacatctaccgctacacccgcaccctcggcaacgagcagctcatcgtcatcaccaacttctccgagaagacccccgtcttccgcctccccgaccacatcatctacaagaccaaggagctcctcatctccaactacgacgtcgacgaggccgaggagctcaaggagatccgcctccgcccctgggaggcccgcgtctacaagatccgcctcccc

SEQ ID NO: 20682 - RNA, 1686 nt, synthetic construct; identical to SEQ ID NO: 20680
  misc_feature 1..1686: note = derived and/or modified sequence opt2 from anti-influenza_Chain
  source 1..1686: mol_type = other RNA

SEQ ID NO: 20683 - RNA, 1686 nt, synthetic construct; identical to SEQ ID NO: 20681
  misc_feature 1..1686: note = derived and/or modified sequence opt2 from anti-influenza_Chain
  source 1..1686: mol_type = other RNA

SEQ ID NO: 20684 - RNA, 1689 nt, synthetic construct
  misc_feature 1..1689: note = derived and/or modified sequence opt2 from anti-influenza_Chain
  source 1..1689: mol_type = other RNA
atggagaagatcgtcctcctcttcgccatcgtctccctcgtcaagtccgaccagatctgcatcggctaccacgccaacaactccaccgagcaggtcgacaccatcatggagaagaacgtcaccgtcacccacgcccaggacatcctcgagaagaagcacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgtcaacgacctctgctaccccggcgacttcaacgactacgaggagctcaagcacctcctctcccgcatcaaccacttcgagaagatccagatcatccccaagtcctcctggtcctcccacgaggcctccctcggcgtctcctccgcctgcccctaccagggcaagacctccttcttccgcaacgtcgtctggctcatcaagaagaactccacctaccccaccatcaagcgctcctacaacaacaccaaccaggaggacctcctcgtcctctggggcatccaccaccccaacgacgccgccgagcagaccaagctctaccagaaccccaccacctacatctccgtcggcacctccaccctcaaccagcgcctcgtcccccgcatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagacccgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatcctctccatctactccaccgtcgcctcctccctcgccctcgccatcatggtcgccggcctctccctctggatgtgctccaacggctccctccagtgccgcatctgc

SEQ ID NO: 20685 - RNA, 1689 nt, synthetic construct; identical to SEQ ID NO: 20684
  misc_feature 1..1689: note = derived and/or modified sequence opt2 from anti-influenza_Chain
  source 1..1689: mol_type = other RNA

SEQ ID NO: 20686 - RNA, 1692 nt, synthetic construct
  misc_feature 1..1692: note = derived and/or modified sequence opt2 from anti-influenza_Chain
  source 1..1692: mol_type = other RNA
atggagaagatcgtcctcctcttcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgctccctcaacggcgtcaagcccctcatcctccgcgactgctccgtcgccggctggctcctcggcaaccccatgtgcgacgagttcctcaacgtccccgagtggtcctacatcgtcgagaaggactcccccatcaacggcctctgctaccccggcgacttcaacgactacgaggagctcaagcacctcctctcctccaccaaccacttcgagaagatccagatcatcccccgctcctcctggtccgaccacgacgcctcctccggcgtctcctccgcctgcccctacaacggccgctcctccttcttccgcaacgtcgtctggctcatcaagaagaacaacgcctaccccaccatcaagcgcaactacaacaacaccaaccaggaggacctcctcgtcctctggggcatccaccaccccaacgacgccaccgagcagaccaagctctaccagaaccccaccacctacgtctccgtcggcacctccaccctcaaccagcgctccgtccccgagatcgccacccgccccaaggtcaacggccagtccggccgcatcgagttcttctggaccatcctcaagcccaacgacgccatcaacttcgagtccaacggcaacttcatcgcccccgagtacgcctacaagatcgccaagaagggcgactccgccatcatgaagtccggcctcgagtacggcaactgcaacaccaagtgccagacccccatgggcgccatcaactcctccatgcccttccacaacatccaccccctcaccatcggcgagtgcccccgctacgtcaagtccgaccgcctcgtcctcgccaccggcctccgcaacgtcccccagcgcgagacccgcggcctcttcggcgccatcgccggcttcatcgagggcggctggcagggcatggtcgacggctggtacggctaccaccactccaacgagcagggctccggctacgccgccgacaaggagtccacccagaaggccatcgacggcatcaccaacaaggtcaactccatcatcgacaagatgaacacccagttcgaggccgtcggcaaggagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacgacgagtgcatggagtccgtccgcaacggcacctacgactacccccagtactccgaggaggcccgcctcaaccgcgaggagatctccggcgtcaagctcgagtccatcggcacctaccagatcctctccatctactccaccgtcgcctcctccctcgccctcgccatcatggtcgccggcctctccttctggatgtgctccaacggctccctccagtgccgcatctgcatc

SEQ ID NO: 20687 - RNA, 1692 nt, synthetic construct; identical to SEQ ID NO: 20686
  misc_feature 1..1692: note = derived and/or modified sequence opt2 from anti-influenza_Chain
  source 1..1692: mol_type = other RNA

SEQ ID NO: 20688 - RNA, 1695 nt, synthetic construct
  misc_feature 1..1695: note = derived and/or modified sequence opt2 from anti-influenza_Chain
  source 1..1695: mol_type = other RNA
atggagaagatcgtcctcctcttcgccatcgtctccctcgtcaagtccgaccagatctgcatcggctaccacgccaacaactccaccgagcaggtcgacaccatcatggagaagaacgtcaccgtcacccacgcccaggacatcctcgagaagaagcacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgtcaacgacctctgctaccccggcgacttcaacgactacgaggagctcaagcacctcctctcccgcatcaaccacttcgagaagatccagatcatccccaagtcctcctggtcctcccacgaggcctccctcggcgtctcctccgcctgcccctaccagggcaagtcctccttcttccgcaacgtcgtctggctcatcaagaagaactccacctaccccaccatcaagcgctcctacaacaacaccaaccaggaggacctcctcgtcctctggggcatccaccaccccaacgacgccgccgagcagaccaagctctaccagaaccccaccacctacatctccgtcggcacctccaccctcaaccagcgcctcgtcccccgcatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatcctctccatctactccaccgtcgcctcctccctcgccctcgccatcatggtcgccggcctctccctctggatgtgctccaacggctccctccagtgccgc

SEQ ID NO: 20689 - RNA, 1695 nt, synthetic construct
  misc_feature 1..1695: note = derived and/or modified sequence opt2 from anti-influenza_Chain
  source 1..1695: mol_type = other RNA
atggagaagatcgtcctcctcttcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgtcaacgacctctgctaccccggcgacttcaacgactacgaggagctcaagcacctcctctcccgcatcaaccacttcgagaagatccagatcatccccaagtcctcctggtcctcccacgaggcctccctcggcgtctcctccgcctgcccctaccagggcaagtcctccttcttccgcaacgtcgtctggctcatcaagaagaactccacctaccccaccatcaagcgctcctacaacaacaccaaccaggaggacctcctcgtcctctggggcatccaccaccccaacgacgccgccgagcagaccaagctctaccagaaccccaccacctacatctccgtcggcacctccaccctcaaccagcgcctcgtcccccgcatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatcctctccatctactccaccgtcgcctcctccctcgccctcgccatcatggtcgccggcctctccctctggatgtgctccaacggctccctccagtgccgc

SEQ ID NO: 20690 - RNA, 1695 nt, synthetic construct
  misc_feature 1..1695: note = derived and/or modified sequence opt2 from anti-influenza_Chain
  source 1..1695: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaagtcctccttcttccgcaacgtcgtctggctcatcaagaagaactcctcctaccccaccatcaagcgctcctacaacaacaccaaccaggaggacctcctcgtcctctggggcatccaccaccccaacgacgccgccgagcagacccgcctctaccagaaccccaccacctacatctccgtcggcacctccaccctcaaccagcgcctcgtccccaagatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccgccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatcctctccatctactccaccgtcgcctcctccctcgccctcgccatcatggtcgccggcctctccctctggatgtgctccaacggctccctccagtgccgc

SEQ ID NO: 20691 - RNA, 1695 nt, synthetic construct
  misc_feature 1..1695: note = derived and/or modified sequence opt2 from anti-influenza_Chain
  source 1..1695: mol_type = other RNA
atgtccgaccgccgccagaaccgcaagacccccgacgagcagcgcaaggccaacgccctcatcatcaacgagaacatcgaggcctacatcgccatctgcaaggaggtcggcctcaacggcgacgagatgctcatcctcgagaacggcatcgccatcgagaaggccatccgcatctgctgcgacggcaagtaccaggagaagcgcgagaagaaggcccgcgaggcccagcgcgccgactccaacttcaacgccgactccatcggcatccgcctcgtcaagcgcgccggctccggcaccaacatcacctaccacgccgtcgtcgagctcacctcccgctcccgcatcgtccagatcctcaagtcccactggggcaacgagctcaaccgcgccaagatcgccggcaagcgcctcggcttctccgccctcttcgcctccaacctcgaggccatcatctaccagcgcggccgcaacgccgcccgccgcaacggctccgccgagctcttcaccctcacccagggcgccggcatcgagacccgctacaagtggatcatggagaagcacatcggcatcggcgtcctcatcgccgacgccaagggcctcatcaacggcaagcgcgagggcaagcgcggcgtcgacgccaacgtcaagctccgcgccggcaccaccggctcccccctcgagcgcgccatgcagggcatcgagaagaaggccttccccggccccctccgcgccctcgcccgccgcgtcgtcaaggccaactacaacgacgcccgcgaggccctcaacgtcatcgccgaggcctccctcctcctcaagccccagatcaccaacaagatgaccatgccctggtgcatgtggctcgccgcccgcctcaccctcaaggacgagttcgccaacttctgcgcctacgccggccgccgcgccttcgaggtcttcaacatcgccatggagaagatcggcatctgctccttccagggcaccatcatgaacgacgacgagatcgagtccatcgaggacaaggcccaggtcctcatgatggcctgcttcggcctcgcctacgaggacttctccctcgtctccgccatggtctcccaccccctcaagctccgcaaccgcatgaagatcggcaacttccgcgtcggcgagaaggtctccaccgtcctctcccccctcctccgcttcacccgctgggccgagttcgcccagcgcttcgccctccaggccaacacctcccgcgagggcgcccagatctccaactccgccgtcttcgccgtcgagcgcaagatcaccaccgacgtccagcgcgtcgaggagctcctcaacaaggtccaggcccacgaggacgagcccctccagaccctctacaagaaggtccgcgagcagatctccatcatcggccgcaacaagtccgagatcaaggagttcctcggctcctccatgtacgacctcaacgaccaggagaagcagaaccccatcaacttccgctccggcgcccaccccttcttcttcgagttcgaccccgactacaaccccatccgcgtcaagcgccccaagaagcccatcgccaagcgcaactccaacatctcccgcctcgaggaggagggcatggacgagaactccgagatcggccaggccaagaagatgaagcccctcgaccagctcacctccacctcctccaacatccccggcaagaac

SEQ ID NO: 20692 - RNA, 1695 nt, synthetic construct
  misc_feature 1..1695: note = derived and/or modified sequence opt2 from anti-influenza_Chain
  source 1..1695: mol_type = other RNA
atgaaggtcaagctcctcgtcctcctctgcaccttcaccgccacctacgccgacaccatctgcatcggctaccacgccaacaactccaccgacaccgtcgacaccgtcctcgagaagaacgtcaccgtcacccactccgtcaacctcctcgagaactcccacaacggcaagctctgcctcctcaagggcatcgcccccctccagctcggcaactgctccgtcgccggctggatcctcggcaaccccgagtgcgagctcctcatctccaaggagtcctggtcctacatcgtcgagaagcccaaccccgagaacggcacctgctaccccggccacttcgccgactacgaggagctccgcgagcagctctcctccgtctcctccttcgagcgcttcgagatcttccccaaggagtcctcctggcccaaccacaccgtcaccggcgtctccgcctcctgctcccacaacggcgagtcctccttctaccgcaacctcctctggctcaccggcaagaacggcctctaccccaacctctccaagtcctacgccaacaacaaggagaaggaggtcctcgtcctctggggcgtccaccacccccccaacatcggcgaccagaaggccctctaccacaccgagaacgcctacgtctccgtcgtctcctcccactactcccgcaagttcacccccgagatcgccaagcgccccaaggtccgcgaccaggagggccgcatcaactaccactggaccctcctcgagcccggcgacaccatcatcttcgaggccaacggcaacctcatcgccccccgctacgccttcaccctctcccgcggcttcggctccggcatcatcaactccaacgcccccatggacaagtgcgacgccaagtgccagaccccccagggcgccatcaactcctccctccccttccagaacgtccaccccgtcaccatcggcgagtgccccaagtacgtccgctccgccaagctccgcatggtcaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgaccagaagtccacccagaacgccatcaacggcatcaccaacaaggtcaactccgtcatcgagaagatgaacacccagttcaccgccgtcggcaaggagttcaacaagctcgagcgccgcatggagaacctcaacaagaaggtcgacgacggcttcatcgacatctggacctacaacgccgagctcctcgtcctcctcgagaacgagcgcaccctcgacttccacgactccaacgtcaagaacctctacgagaaggtcaagtcccagctcaagaacaacgccaaggagatcggcaacggctgcttcgagttctaccacaagtgcaacgacgagtgcatggagtccgtcaagaacggcacctacgactaccccaagtactccgaggagtccaagctcaaccgcgagaagatcgacggcgtcaagctcgagtccatgggcgtctaccagatcctcgccatctactccaccgtcgcctcctccctcgtcctcctcgtctccctcggcgccatctccttctggatgtgctccaacggctccctccagtgccgcatctgcatc

SEQ ID NO: 20693 - RNA, 1695 nt, synthetic construct
  misc_feature 1..1695: note = derived and/or modified sequence opt2 from anti-influenza_Chain
  source 1..1695: mol_type = other RNA
atgaaggtcaagctcctcgtcctcctctgcaccttcaccgccacctacgccgacaccatctgcatcggctaccacgccaacaactccaccgacaccgtcgacaccgtcctcgagaagaacgtcaccgtcacccactccgtcaacctcctcgagaactcccacaacggcaagctctgcctcctcaagggcatcgcccccctccagctcggcaactgctccgtcgccggctggatcctcggcaaccccgagtgcgagctcctcatctccaaggagtcctggtcctacatcgtcgagaagcccaaccccgagaacggcacctgctaccccggccacttcgccgactacgaggagctccgcgagcagctctcctccgtctcctccttcgagcgcttcgagatcttccccaaggagtcctcctggcccaaccacaccgtcaccggcgtctccgcctcctgctcccacaacggcgagtcctccttctaccgcaacctcctctggctcaccggcaagaacggcctctaccccaacctctccaagtcctacgccaacaacaaggagaaggaggtcctcgtcctctggggcgtccaccacccccccaacatcggcgaccagaagaccctctaccacaccgagaacgcctacgtctccgtcgtctcctcccactactcccgcaagttcacccccgagatcgccaagcgccccaaggtccgcgaccaggagggccgcatcaactactactggaccctcctcgagcccggcgacaccatcatcttcgaggccaacggcaacctcatcgccccccgctacgccttcgccctctcccgcggcttcggctccggcatcatcaactccaacgcccccatggacaagtgcgacgccaagtgccagaccccccagggcgccatcaactcctccctccccttccagaacgtccaccccgtcaccatcggcgagtgccccaagtacgtccgctccgccaagctccgcatggtcaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgaccagaagtccacccagaacgccatcaacggcatcaccaacaaggtcaactccgtcatcgagaagatgaacacccagttcaccgccgtcggcaaggagttcaacaagctcgagcgccgcatggagaacctcaacaagaaggtcgacgacggcttcatcgacatctggacctacaacgccgagctcctcgtcctcctcgagaacgagcgcaccctcgacttccacgactccaacgtcaagaacctctacgagaaggtcaagtcccagctcaagaacaacgccaaggagatcggcaacggctgcttcgagttctaccacaagtgcaacgacgagtgcatggagtccgtcaagaacggcacctacgactaccccaagtactccgaggagtccaagctcaaccgcgagaagatcgacggcgtcaagctcgagtccatgggcgtctaccagatcctcgccatctactccaccgtcgcctcctccctcgtcctcctcgtctccctcggcgccatctccttctggatgtgctccaacggctccctccagtgccgcatctgcatc

SEQ ID NO: 20694 - RNA, 1695 nt, synthetic construct
  misc_feature 1..1695: note = derived and/or modified sequence opt2 from anti-influenza_Chain
  source 1..1695: mol_type = other RNA
atgaaggtcaagctcctcgtcctcctctgcaccttcaccgccacctacgccgacaccatctgcatcggctaccacgccaacaactccaccgacaccgtcgacaccgtcctcgagaagaacgtcaccgtcacccactccgtcaacctcctcgagaactcccacaacggcaagctctgcctcctcaagggcatcgcccccctccagctcggcaactgctccgtcgccggctggatcctcggcaaccccgagtgcgagctcctcatctccaaggagtcctggtcctacatcgtcgagaagcccaaccccgagaacggcacctgctaccccggccacttcgccgactacgaggagctccgcgagcagctctcctccgtctcctccttcgagcgcttcgagatcttccccaaggagtcctcctggcccaaccacaccgtcaccggcgtctccgcctcctgctcccacaacggcgagtcctccttctaccgcaacctcctctggctcaccggcaagaacggcctctaccccaacctctccaagtcctacgccaacaacaaggagaaggaggtcctcgtcctctggggcgtccaccacccccccgacatcggcgaccagaagaccctctaccacaccgagaacgcctacgtctccgtcgtctcctcccactactcccgcaagttcacccccgagatcgccaagcgccccaaggtccgcgaccaggagggccgcatcaactactactggaccctcctcgagcccggcgacaccatcatcttcgaggccaacggcaacctcatcgccccccgctacgccttcgccctctcccgcggcttcggctccggcatcatcaactccaacgcccccatggacaagtgcgacgccaagtgccagaccccccagggcgccatcaactcctccctccccttccagaacgtccaccccgtcaccatcggcgagtgccccaagtacgtccgctccgccaagctccgcatggtcaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgaccagaagtccacccagaacgccatcaacggcatcaccaacaaggtcaactccgtcatcgagaagatgaacacccagttcaccgccgtcggcaaggagttcaacaagctcgagcgccgcatggagaacctcaacaagaaggtcgacgacggcttcatcgacatctggacctacaacgccgagctcctcgtcctcctcgagaacgagcgcaccctcgacttccacgactccaacgtcaagaacctctacgagaaggtcaagtcccagctcaagaacaacgccaaggagatcggcaacggctgcttcgagttctaccacaagtgcaacgacgagtgcatggagtccgtcaagaacggcacctacgactaccccaagtactccgaggagtccaagctcaaccgcgagaagatcgacggcgtcaagctcgagtccatgggcgtctaccagatcctcgccatctactccaccgtcgcctcctccctcgtcctcctcgtctccctcggcgccatctccttctggatgtgctccaacggctccctccagtgccgcatctgcatc

SEQ ID NO: 20695 - RNA, 1695 nt, synthetic construct
  misc_feature 1..1695: note = derived and/or modified sequence opt2 from anti-influenza_Chain
  source 1..1695: mol_type = other RNA
atgaaggtcaagctcctcgtcctcctctgcaccttcaccgccacctacgccgacaccatctgcatcggctaccacgccaacaactccaccgacaccgtcgacaccgtcctcgagaagaacgtcaccgtcacccactccgtcaacctcctcgagaactcccacaacggcaagctctgcctcctcaagggcatcgcccccctccagctcggcaactgctccgtcgccggctggatcctcggcaaccccgagtgcgagctcctcatctccaaggagtcctggtcctacatcgtcgagaagcccaaccccgagaacggcacctgctaccccggccacttcgccgactacgaggagctccgcgagcagctctcctccgtctcctccttcgagcgcttcgagatcttccccaaggagtcctcctggcccaaccacaccgtcaccggcgtctccgcctcctgctcccacaacggcgagtcctccttctaccgcaacctcctctggctcaccggcaagaacggcctctaccccaacctctccaagtcctacgccaacaacaaggagaaggaggtcctcgtcctctggggcgtccaccacccccccaacatcggcgaccagaaggccctctaccacaccgagaacgcctacgtctccgtcgtctcctcccactactcccgcaagttcacccccgagatcgccaagcgccccaaggtccgcgaccaggagggccgcatcaactactactggaccctcctcgagcccggcgacaccatcatcttcgaggccaacggcaacctcatcgccccccgctacgccttcgccctctcccgcggcttcggctccggcatcatcaactccaacgcccccatggacaagtgcgacgccaagtgccagaccccccagggcgccatcaactcctccctccccttccagaacgtccaccccgtcaccatcggcgagtgccccaagtacgtccgctccgccaagctccgcatggtcaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgaccagaagtccacccagaacgccatcaacggcatcaccaacaaggtcaactccgtcatcgagaagatgaacacccagttcaccgccgtcggcaaggagttcaacaagctcgagcgccgcatggagaacctcaacaagaaggtcgacgacggcttcatcgacatctggacctacaacgccgagctcctcgtcctcctcgagaacgagcgcaccctcgacttccacgactccaacgtcaagaacctctacgagaaggtcaagtcccagctcaagaacaacgccaaggagatcggcaacggctgcttcgagttctaccacaagtgcaacgacgagtgcatggagtccgtcaagaacggcacctacgactaccccaagtactccgaggagtccaagctcaaccgcgagaagatcgacggcgtcaagctcgagtccatgggcgtctaccagatcctcgccatctactccaccgtcgcctcctccctcgtcctcctcgtctccctcggcgccatctccttctggatgtgctccaacggctccctccagtgccgcatctgcatc

SEQ ID NO: 20696 - RNA, 1695 nt, synthetic construct
  misc_feature 1..1695: note = derived and/or modified sequence opt2 from anti-influenza_Chain
  source 1..1695: mol_type = other RNA
atgaaggccaagctcctcgtcctcctctgcaccttcaccgccacctacgccgacaccatctgcatcggctaccacgccaacaactccaccgacaccgtcgacaccgtcctcgagaagaacgtcaccgtcacccactccgtcaacctcctcgaggactcccacaacggcaagctctgcctcctcaagggcatcgcccccctccagctcggcaactgctccgtcgccggctggatcctcggcaaccccgagtgcgagctcctcatctccaaggagtcctggtcctacatcgtcgagacccccaaccccgagaacggcacctgctaccccggctacttcgccgactacgaggagctccgcgagcagctctcctccgtctcctccttcgagcgcttcgagatcttccccaaggagtcctcctggcccaaccacaccgtcaccggcgtctccgcctcctgctcccacaacggcaagtcctccttctaccgcaacctcctctggctcaccggcaagaacggcctctaccccaacctctccaagtcctacgtcaacaacaaggagaaggaggtcctcgtcctctggggcgtccaccacccccccaacatcggcaaccagcgcgccctctaccacaccgagaacgcctacgtctccgtcgtctcctcccactactcccgccgcttcacccccgagatcgccaagcgccccaaggtccgcgaccaggagggccgcatcaactactactggaccctcctcgagcccggcgacaccatcatcttcgaggccaacggcaacctcatcgccccctggtacgccttcgccctctcccgcggcttcggctccggcatcatcacctccaacgcccccatggacgagtgcgacgccaagtgccagaccccccagggcgccatcaactcctccctccccttccagaacgtccaccccgtcaccatcggcgagtgccccaagtacgtccgctccgccaagctccgcatggtcaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgaccagaagtccacccagaacgccatcaacggcatcaccaacaaggtcaactccgtcatcgagaagatgaacacccagttcaccgccgtcggcaaggagttcaacaagctcgagcgccgcatggagaacctcaacaagaaggtcgacgacggcttcctcgacatctggacctacaacgccgagctcctcgtcctcctcgagaacgagcgcaccctcgacttccacgactccaacgtcaagaacctctacgagaaggtcaagtcccagctcaagaacaacgccaaggagatcggcaacggctgcttcgagttctaccacaagtgcaacaacgagtgcatggagtccgtcaagaacggcacctacgactaccccaagtactccgaggagtccaagctcaaccgcgagaagatcgacggcgtcaagctcgagtccatgggcgtctaccagatcctcgccatctactccaccgtcgcctcctccctcgtcctcctcgtctccctcggcgccatctccttctggatgtgctccaacggctccctccagtgccgcatctgcatc

SEQ ID NO: 20697 - RNA, 1695 nt, synthetic construct
  misc_feature 1..1695: note = derived and/or modified sequence opt2 from anti-influenza_Chain
  source 1..1695: mol_type = other RNA
atgaaggtcaagctcctcgtcctcctctgcaccttcaccgccacctacgccgacaccatctgcatcggctaccacgccaacaactccaccgacaccgtcgacaccgtcctcgagaagaacgtcaccgtcacccactccgtcaacctcctcgaggactcccacaacggcaagctctgcctcctcaagggcatcgcccccctccagctcggcaactgctccgtcgccggctggatcctcggcaaccccgagtgcgagctcctcatctcccgcgagtcctggtcctacatcgtcgagaagcccaaccccgagaacggcacctgctaccccggccacttcgccgactacgaggagctccgcgagcagctctcctccgtctcctccttcgagcgcttcgagatcttccccaaggagtcctcctggcccaaccacaccaccaccggcgtctccgcctcctgctcccacaacggcgagtcctccttctacaagaacctcctctggctcaccggcaagaacggcctctaccccaacctctccaagtcctacgccaacaacaaggagaaggaggtcctcgtcctctggggcgtccaccacccccccaacatcggcgaccagcgcgccctctaccacaaggagaacgcctacgtctccgtcgtctcctcccactactcccgcaagttcacccccgagatcgccaagcgccccaaggtccgcgaccaggagggccgcatcaactactactggaccctcctcgagcccggcgacaccatcatcttcgaggccaacggcaacctcatcgccccccgctacgccttcgccctctcccgcggcttcggctccggcatcatcaactccaacgcccccatggacgagtgcgacgccaagtgccagaccccccagggcgccatcaactcctccctccccttccagaacgtccaccccgtcaccatcggcgagtgccccaagtacgtccgctccgccaagctccgcatggtcaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgaccagaagtccacccagaacgccatcaacggcatcaccaacaaggtcaactccgtcatcgagaagatgaacacccagttcaccgccgtcggcaaggagttcaacaagctcgagcgccgcatggagaacctcaacaagaaggtcgacgacggcttcatcgacatctggacctacaacgccgagctcctcgtcctcctcgagaacgagcgcaccctcgacttccacgactccaacgtcaagaacctctacgagaaggtcaagtcccagctcaagaacaacgccaaggagatcggcaacggctgcttcgagttctaccacaagtgcaacgacgagtgcatggagtccgtcaagaacggcacctacgactaccccaagtactccgaggagtccaagctcaaccgcgagaagatcgacggcgtcaagctcgagtccatgggcgtctaccagatcctcgccatctactccaccgtcgcctcctccctcgtcctcctcgtctccctcggcgccatctccttctggatgtgctccaacggctccctccagtgccgcatctgcatc

SEQ ID NO: 20698 - RNA, 1677 nt, synthetic construct
  misc_feature 1..1677: note = derived and/or modified sequence opt2 from anti-influenza_Chain
  source 1..1677: mol_type = other RNA
gacaagatctgcatcggctaccagtccaccaactccaccgagaccgtcgacaccctcaccaagaccaacgtccccgtcacccaggccaaggagctcctccacaccgagcacaacggcatgctctgcgccaccaacctcggccaccccctcatcctcgacacctgcaccatcgagggcctcatctacggcaacccctcctgcgacctcctcctcggcggccgcgagtggtcctacatcgtcgagcgcccctccgccgtcaacggcatgtgctaccccggcaacgtcgagaacctcgaggagctccgcctcctcttctcctccgcctcctcctaccagcgcgtccagatcttccccgacaccatctggaacgtcacctactccggcacctcctccgcctgctccaactccttctaccgctccatgcgctggctcacccagaaggacaacacctaccccgtccaggacgcccagtacaccaacaaccgcggcaagtccatcctcttcatgtggggcatcaaccacccccccaccgacaccgtccagaccaacctctacacccgcaccgacaccaccacctccgtcaccaccgaggacatcaaccgcgccttcaagcccgtcatcggcccccgccccctcgtcaacggcctccagggccgcatcgactactactggtccgtcctcaagcccggccagaccctccgcgtccgctccaacggcaacctcatcgccccctggtacggccacatcctctccggcgagtcccacggccgcatcctcaagtccgacctcaactccggcaactgcgtcgtccagtgccagaccgagcgcggcggcctcaacaccaccctccccttccacaacgtctccaagtacgccttcggcaactgccccaagtacgtcggcgtcaagtccctcaagctcgccgtcggcatgcgcaacgtccccgcccgctcctcccgcggcctcttcggcgccatcgccggcttcatcgagggcggctggcccggcctcgtcgccggctggtacggcttccagcactccaacgaccagggcgtcggcatggccgccgaccgcgactccacccagaaggccatcgacaagatcacctccaaggtcaacaacatcgtcgacaagatgaacaagcagtacgagatcatcgaccacgagttctccgagatcgagacccgcctcaacatgatcaacaacaagatcgacgaccagatccaggacatctgggcctacaacgccgagctcctcgtcctcctcgagaaccagaagaccctcgacgagcacgacgccaacgtcaacaacctctacaacaaggtcaagcgcgccctcggctccaacgccatggaggacggcaagggctgcttcgagctctaccacaagtgcgacgaccgctgcatggagaccatccgcaacggcacctacaaccgcggcaagtacaaggaggagtcccgcctcgagcgccagaagatcgagggcgtcaagctcgagtccgagggcacctacaagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20699 - RNA, 1677 nt, synthetic construct; identical to SEQ ID NO: 20698
  misc_feature 1..1677: note = derived and/or modified sequence opt2 from anti-influenza_Chain
  source 1..1677: mol_type = other RNA

SEQ ID NO: 20700 - RNA, 1695 nt, synthetic construct; identical to SEQ ID NO: 20691
  misc_feature 1..1695: note = derived and/or modified sequence opt2 from anti-influenza_Chain
  source 1..1695: mol_type = other RNA

SEQ ID NO: 20701 - RNA, 1695 nt, synthetic construct; identical to SEQ ID NO: 20688
  misc_feature 1..1695: note = derived and/or modified sequence opt2 from anti-influenza_Chain
  source 1..1695: mol_type = other RNA

SEQ ID NO: 20702 - RNA, 1695 nt, synthetic construct; identical to SEQ ID NO: 20689
  misc_feature 1..1695: note = derived and/or modified sequence opt2 from anti-influenza_Chain
  source 1..1695: mol_type = other RNA

SEQ ID NO: 20703 - RNA, 1695 nt, synthetic construct; identical to SEQ ID NO: 20690
  misc_feature 1..1695: note = derived and/or modified sequence opt2 from anti-influenza_Chain
  source 1..1695: mol_type = other RNA

SEQ ID NO: 20704 - RNA, 1695 nt, synthetic construct; identical to SEQ ID NO: 20692
  misc_feature 1..1695: note = derived and/or modified sequence opt2 from anti-influenza_Chain
  source 1..1695: mol_type = other RNA

SEQ ID NO: 20705 - RNA, 1695 nt, synthetic construct; identical to SEQ ID NO: 20693
  misc_feature 1..1695: note = derived and/or modified sequence opt2 from anti-influenza_Chain
  source 1..1695: mol_type = other RNA

SEQ ID NO: 20706 - RNA, 1695 nt, synthetic construct; identical to SEQ ID NO: 20694
  misc_feature 1..1695: note = derived and/or modified sequence opt2 from anti-influenza_Chain
  source 1..1695: mol_type = other RNA

SEQ ID NO: 20707 - RNA, 1695 nt, synthetic construct; identical to SEQ ID NO: 20695
  misc_feature 1..1695: note = derived and/or modified sequence opt2 from anti-influenza_Chain
  source 1..1695: mol_type = other RNA

SEQ ID NO: 20708 - RNA, 1695 nt, synthetic construct; identical to SEQ ID NO: 20696
  misc_feature 1..1695: note = derived and/or modified sequence opt2 from anti-influenza_Chain
  source 1..1695: mol_type = other RNA

SEQ ID NO: 20709 - RNA, 1695 nt, synthetic construct; identical to SEQ ID NO: 20697
  misc_feature 1..1695: note = derived and/or modified sequence opt2 from anti-influenza_Chain
  source 1..1695: mol_type = other RNA

SEQ ID NO: 20710 - RNA, 1698 nt, synthetic construct
  misc_feature 1..1698: note = derived and/or modified sequence opt2 from anti-influenza_Chain
  source 1..1698: mol_type = other RNA
atgaagaccatcatcgccctctcctacatcctctgcctcgtcttcgcccagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcggcatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacaacgagtccttcaactggaccggcgtcacccagaacggcacctcctccgcctgcaagcgccgctccaacaactccttcttctcccgcctcaactggctcacccacctcaagttcaagtaccccgccctcaacgtcaccatgcccaacaacgagaagttcgacaagctctacatctggggcgtccaccaccccggcaccgacaacgaccagatctccctctacgcccaggcctccggccgcatcaccgtctccaccaagcgctcccagcagaccgtcatcccctccatcggctcccgcccccgcatccgcgacgtcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcaccggccaggccgccgacctcaagtccacccaggccgccatcaaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagcgcaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatctgcatc

SEQ ID NO: 20711 - RNA, 1698 nt, synthetic construct
  misc_feature 1..1698: note = derived and/or modified sequence opt2 from anti-influenza_Chain
  source 1..1698: mol_type = other RNA
atgaagaccatcatcgccctctcctacatcctctgcctcgtctccgcccagaagttccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcgagatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacaacgagtccttcaactggaccggcgtcacccagaacggcacctcctccgcctgcatccgccgctccaacaactccttcttctcccgcctcaactggctcacccacctcaagttcaagtaccccgccctcaacgtcaccatgcccaacaacgaggagttcgacaagctctacatctggggcgtccaccaccccggcaccgacaacgaccagatcttcctctacgcccaggcctccggccgcatcaccgtctccaccaagcgctcccagcagaccgtcatccccaacatccgctcccgcccccgcgtccgcaacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcatcggccaggccgccgacctcaagtccacccaggccgccatcgaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagaagaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatctgcatc

SEQ ID NO: 20712 - RNA, 1698 nt, synthetic construct
  misc_feature 1..1698: note = derived and/or modified sequence opt2 from anti-influenza_Chain
  source 1..1698: mol_type = other RNA
atgaagaccatcatcgccctctcctacatcctctgcctcgtcttcgcccagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcgagatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaagaacgagtccttcaactggaccggcgtcacccagaacggcacctcctccgcctgcatccgccgctccaacaactccttcttctcccgcctcaactggctcacccacctcaagttcaagtaccccgccctcaacgtcaccatgcccaacaaggagaagttcgacaagctctacatctggggcgtccaccaccccggcaccgacaacgaccagatcttcctctacgcccaggcctccggccgcatcaccgtctccaccaagcgctcccagcagaccgtcatccccaacatcggctcccgcctccgcgtccgcgacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcaccggccaggccgccgacctcaagtccacccaggccgccatcgaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagaagaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatctgcatc

SEQ ID NO: 20713 - RNA, 1698 nt, synthetic construct
  misc_feature 1..1698: note = derived and/or modified sequence opt2 from anti-influenza_Chain
  source 1..1698: mol_type = other RNA
atgaagaccatcatcgccctctcctacatcctctgcctcgtcttcgcccagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcgagatctgcgactccccccaccagatcctcgacggcgagaactgcaccctcatcgacgccctcctcggcgacccccagtgcgacggcttccagaacaagaagtgggacctcttcgtcgagcgctccaaggcctactccaagtgctacccctacgacgtccccgactacgcctccctccgctccctcgtcgcctcctccggcaccctcgagttcaacaacgagtccttcaactggaccggcgtcacccagaacggcacctcctccgcctgcatccgccgctccaacaactccttcttctcccgcctcaactggctcacccacctcaagttcaagtaccccgccctcaacgtcaccatgcccaacaacgagaagttcgacaagctctacatctggggcgtccaccaccccggcaccgacaacgaccagatcttcctctacgcccaggcctccggccgcatcaccgtctccaccaagcgctcccagcagaccgtcatccccaacatcggctcccgcccccgcgtccgcgacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcatcggccaggccgccgacctcaagtccacccaggccgccatcgaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagaagaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatctgcatc

SEQ ID NO: 20714 - RNA, 1698 nt, synthetic construct
  misc_feature 1..1698: note = derived and/or modified sequence opt2 from anti-influenza_Chain
  source 1..1698: mol_type = other RNA
atgaagaccatcatcgccctctcctacatcctctgcctcgtcttcgcccagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcgagatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacaacgagtccttcaactggaccggcgtcacccagaacggcacctcctccgcctgcatccgccgctccaacaactccttcttctcccgcctcaactggctcacccacctcaagttcaagtaccccgccctcaacgtcaccatgcccaacaacgagaagttcgacaagctctacatctggggcgtccaccaccccggcaccgacaacgaccagatcttcctctacgcccaggcctccggccgcatcaccgtctccaccaagcgctcccagcagaccgtcatccccaacatcggctcccgcccccgcgtccgcaacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcatcggccaggccgccgacctcaagtccacccaggccgccatcgaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagaagaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatctgcatc

SEQ ID NO: 20715 - RNA, 1698 nt, synthetic construct
  misc_feature 1..1698: note = derived and/or modified sequence opt2 from anti-influenza_Chain
  source 1..1698: mol_type = other RNA
atgaagaccatcatcgccctctcctacatcctctgcctcgtcttctcccagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcggcatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacaacgagtccttcaactgggccggcgtcacccagaacggcacctcctccgcctgcaagcgccgctccaacaagtccttcttctcccgcctcaactggctcacccacctcaagtacaagtaccccgccctcaacgtcaccatgcccaacaacgagaagttcgacaagctctacatctggggcgtccaccaccccgtcaccgactccgaccagatctccctctacgcccaggcctccggccgcatcaccgtctccaccaagcgctcccagcagaccgtcatccccaacatcggctaccgcccccgcgtccgcgacatctcctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcaccggccaggccgccgacctcaagtccacccaggccgccatcaaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagcgcaccaagaagcagctccgcgagaacgccgaggacatgggcaacggctgcttcaagatctaccacaagtgcgacaacgcctgcatcgagtccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatctgcatc

SEQ ID NO: 20716 - RNA, 1698 nt, synthetic construct
  misc_feature 1..1698: note = derived and/or modified sequence opt2 from anti-influenza_Chain
  source 1..1698: mol_type = other RNA
atgaagaccatcatcgccctctcctacatcctctgcctcgtcttcgcccagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcggcatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacgacgagtccttcaactggaccggcgtcacccagaacggcacctcctcctcctgcaagcgccgctccaacaactccttcttctcccgcctcaactggctcacccacctcaagttcaagtaccccgccctcaacgtcaccatgcccaacaacgagaagttcgacaagctctacatctggggcgtccaccaccccgtcaccgacaacgaccagatcttcctctacgcccaggcctccggccgcatcaccgtctccaccaagcgctcccagcagaccgtcatccccaacatcggctcccgcccccgcatccgcaacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcatcggccaggccgccgacctcaagtccacccaggccgccatcaaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagcgcaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctacaaggactggatcctctggatctccttcgccatctcctgcttcctcctctgcgtcgccctcctcggcttcatcatgtgggcctgccagaagggcaacatccgctgcaacatctgcatc

SEQ ID NO: 20717 - RNA, 1698 nt, synthetic construct
  misc_feature 1..1698: note = derived and/or modified sequence opt2 from anti-influenza_Chain
  source 1..1698: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccaccaacgacctctgctaccccggctccttcaacgactacgaggagctcaagcacctcctctcccgcatcaaccacttcgagaagatccagatcatccccaagtcctcctggtccgaccacgaggcctcctccggcgtctcctccgcctgcccctacctcggctccccctccttcttccgcaacgtcgtctggctcatcaagaagaactccacctaccccaccatcaagaagtcctacaacaacaccaaccaggaggacctcctcgtcctctggggcatccaccaccccaacgacgccgccgagcagacccgcctctaccagaaccccaccacctacatctccatcggcacctccaccctcaaccagcgcctcgtccccaagatcgccacccgctccaaggtcaacggccagtccggccgcatggagttcttctgggccatcctcaagcccaacgacgccatcaacttcgagtccaacggcaacttcatcgcccccgagtacgcctacaagatcgtcaagaagggcgactccgccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagtcccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccatccgcaacggcacctacaacccccagtactccgaggaggcccgcctcaagcgcgaggagatctccggcgtcaagctcgagtccatcggcacctaccagatcctctccatctactccaccgtcgcctcctccctcgccctcgccatcatgatcgccggcctctccctctggatgtgctccaacggctccctccagtgccgcatctgcatc

SEQ ID NO: 20718 - RNA, 1698 nt, synthetic construct
  misc_feature 1..1698: note = derived and/or modified sequence opt2 from anti-influenza_Chain
  source 1..1698: mol_type = other RNA
atgaaggccatcctcgtcgtcctcctctacaccttcgccaccgccaacgccgacaccctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacgcctacgtcttcgtcggcacctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcaacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacgtcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaaggtcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgccatctccttctggatgtgctccaacggctccctccagtgccgcatctgcatc

SEQ ID NO: 20719 - RNA, 1698 nt, synthetic construct
  misc_feature 1..1698: note = derived and/or modified sequence opt2 from anti-influenza_Chain
  source 1..1698: mol_type = other RNA
atgaaggccatcctcgtcgtcctcctctacaccttcgccaccgccaacgccgacaccctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagacctcctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccccccacctccgccgaccagcagtccctctaccagaacgccgacgcctacgtcttcgtcggctcctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcaacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaaggtcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagatcctcgccatctactccaccgtcgcctcctccctcgtcctcgtcgtctccctcggcgccatctccttctggatgtgctccaacggctccctccagtgccgcatctgcatc

SEQ ID NO: 20720 - RNA, 1698 nt, synthetic construct; identical to SEQ ID NO: 20717
  misc_feature 1..1698: note = derived and/or modified sequence opt2 from anti-influenza_Chain
  source 1..1698: mol_type = other RNA

SEQ ID NO: 20721 - RNA, 1698 nt, synthetic construct; identical to SEQ ID NO: 20710
  misc_feature 1..1698: note = derived and/or modified sequence opt2 from anti-influenza_Chain
  source 1..1698: mol_type = other RNA

SEQ ID NO: 20722 - RNA, 1698 nt, synthetic construct; identical to SEQ ID NO: 20718
  misc_feature 1..1698: note = derived and/or modified sequence opt2 from anti-influenza_Chain
  source 1..1698: mol_type = other RNA

SEQ ID NO: 20723 - RNA, 1698 nt, synthetic construct; identical to SEQ ID NO: 20719
  misc_feature 1..1698: note = derived and/or modified sequence opt2 from anti-influenza_Chain
  source 1..1698: mol_type = other RNA

SEQ ID NO: 20724 - RNA, 1698 nt, synthetic construct; identical to SEQ ID NO: 20711
  misc_feature 1..1698: note = derived and/or modified sequence opt2 from anti-influenza_Chain
  source 1..1698: mol_type = other RNA

SEQ ID NO: 20725 - RNA, 1698 nt, synthetic construct; identical to SEQ ID NO: 20712
  misc_feature 1..1698: note = derived and/or modified sequence opt2 from anti-influenza_Chain
  source 1..1698: mol_type = other RNA

SEQ ID NO: 20726 - RNA, 1698 nt, synthetic construct; identical to SEQ ID NO: 20713
  misc_feature 1..1698: note = derived and/or modified sequence opt2 from anti-influenza_Chain
  source 1..1698: mol_type = other RNA

SEQ ID NO: 20727 - RNA, 1698 nt, synthetic construct; identical to SEQ ID NO: 20714
  misc_feature 1..1698: note = derived and/or modified sequence opt2 from anti-influenza_Chain
  source 1..1698: mol_type = other RNA

SEQ ID NO: 20728 - RNA, 1698 nt, synthetic construct; identical to SEQ ID NO: 20715
  misc_feature 1..1698: note = derived and/or modified sequence opt2 from anti-influenza_Chain
  source 1..1698: mol_type = other RNA

SEQ ID NO: 20729 - RNA, 1698 nt, synthetic construct; identical to SEQ ID NO: 20716
  misc_feature 1..1698: note = derived and/or modified sequence opt2 from anti-influenza_Chain
  source 1..1698: mol_type = other RNA

SEQ ID NO: 20730 - RNA, 1683 nt, synthetic construct
  misc_feature 1..1683: note = derived and/or modified sequence opt2 from anti-influenza_Chain
  source 1..1683: mol_type = other RNA
atggagaagatcgtcctcctcttcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgtcaacgacctctgctaccccggcgacttcaacgactacgaggagctcaagcacctcctctcccgcatcaaccacttcgagaagatccagatcatccccaagtcctcctggtcctcccacgaggcctccctcggcgtctcctccgcctgcccctaccagggcaagtcctccttcttccgcaacgtcgtctggctcatcaagaagaactccacctaccccaccatcaagcgctcctacaacaacaccaaccaggaggacctcctcgtcctctggggcatccaccaccccaacgacgccgccgagcagaccaagctctaccagaaccccaccacctacatctccgtcggcacctccaccctcaaccagcgcctcgtcccccgcatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatccagcactccggcggccgctcctccctcgagggcccccgcttcgagcagaagctcatctccgaggaggacctcaacatgcacaccggc

SEQ ID NO: 20731 - RNA, 1683 nt, synthetic construct
  misc_feature 1..1683: note = derived and/or modified sequence opt2 from anti-influenza_Chain
  source 1..1683: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaagtcctccttcttccgcaacgtcgtctggctcatcaagaagaactcctcctaccccaccatcaagcgctcctacaacaacaccaaccaggaggacctcctcgtcctctggggcatccaccaccccaacgacgccgccgagcagacccgcctctaccagaaccccaccacctacatctccgtcggcacctccaccctcaaccagcgcctcgtccccaagatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccgccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatccagcactccggcggccgctcctccctcgagggcccccgcttcgagcagaagctcatctccgaggaggacctcaacatgcacaccggc

SEQ ID NO: 20732 - RNA, 1701 nt, synthetic construct
  misc_feature 1..1701: note = derived and/or modified sequence opt2 from anti-influenza_Chain
  source 1..1701: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatctccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacaacgccgccgagcagaccaagctctaccagaaccccaccacctacatctccgtcggcacctccaccctcaacctccgcctcgtccccaagatcgccacccgctccaaggtcaacggccagtccggccgcatggacttcttctggaccatcctcaagcccaacgacgccatcaacttcgagtccaacggcaacttcatcgcccccgagtacgcctacaagatcgtcaagaagggcgactccgccatcatgaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctccgcgagcgccgccgcaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcacctaccagatcctctccatctactccaccgtcgcctcctccctcgccctcgccatcatggtcgccggcctctccctctggatgtgctccaacggctccctccagtgccgcatctgcatc

SEQ ID NO: 20733 - RNA, 1701 nt, synthetic construct
  misc_feature 1..1701: note = derived and/or modified sequence opt2 from anti-influenza_Chain
  source 1..1701: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagtccggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctccgcgagcgccgccgcaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcacctaccagatcctctccatctactccaccgtcgcctcctccctcgccctcgccatcatggtcgccggcctctccctctggatgtgctccaacggctccctccagtgccgcatctgcatc

SEQ ID NO: 20734 - RNA, 1683 nt, synthetic construct
  misc_feature 1..1683: note = derived and/or modified sequence opt2 from anti-influenza_Chain
  source 1..1683: mol_type = other RNA
gacaagatctgcctcggccaccacgccgtctccaacggcaccaaggtcaacaccctcaccgagcgcggcgtcgaggtcgtcaacgccaccgagaccgtcgagcgcaccaacgtcccccgcatctgctccaagggcaagcgcaccgtcgacctcggccagtgcggcctcctcggcaccatcaccggccccccccagtgcgaccagttcctcgagttctccgccgacctcatcatcgagcgccgcgagggctccgacgtctgctaccccggcaagttcgtcaacgaggaggccctccgccagatcctccgcgagtccggcggcatcgacaaggagaccatgggcttcacctactccggcatccgcaccaacggcaccacctccgcctgccgccgctccggctcctccttctacgccgagatgaagtggctcctctccaacaccgacaacgccgccttcccccagatgaccaagtcctacaagaacacccgcaaggaccccgccctcatcatctggggcatccaccactccggctccaccaccgagcagaccaagctctacggctccggcaacaagctcatcaccgtcggctcctccaactaccagcagtccttcgtcccctcccccggcgcccgcccccaggtcaacggccagtccggccgcatcgacttccactggctcatcctcaaccccaacgacaccgtcaccttctccttcaacggcgccttcatcgcccccgaccgcgcctccttcctccgcggcaagtccatgggcatccagtccgaggtccaggtcgacgccaactgcgagggcgactgctaccactccggcggcaccatcatctccaacctccccttccagaacatcaactcccgcgccgtcggcaagtgcccccgctacgtcaagcaggagtccctcctcctcgccaccggcatgaagaacgtccccgagatccccaagcgccgccgccgcggcctcttcggcgccatcgccggcttcatcgagaacggctgggagggcctcatcgacggctggtacggcttccgccaccagaacgcccagggcgagggcaccgccgccgactacaagtccacccagtccgccatcgaccagatcaccggcaagctcaaccgcctcatcgagaagaccaaccagcagttcgagctcatcgacaacgagttcaccgaggtcgagcgccagatcggcaacgtcatcaactggacccgcgactccatgaccgaggtctggtcctacaacgccgagctcctcgtcgccatggagaaccagcacaccatcgacctcgccgactccgagatgaacaagctctacgagcgcgtcaagcgccagctccgcgagaacgccgaggaggacggcaccggctgcttcgagatcttccacaagtgcgacgacgactgcatggcctccatccgcaacaacacctacgaccactccaagtaccgcgaggaggccatccagaaccgcatccagatcgaccccgtcaagctctcctccggctacaaggactccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20735 - RNA, 1701 nt, synthetic construct
  misc_feature 1..1701: note = derived and/or modified sequence opt2 from anti-influenza_Chain
  source 1..1701: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctccgcgagcgccgccgcaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcacctaccagatcctctccatctactccaccgtcgcctcctccctcgccctcgccatcatggtcgccggcctctccctctggatgtgctccaacggctccctccagtgccgcatctgcatc

SEQ ID NO: 20736 - RNA, 1683 nt, synthetic construct; identical to SEQ ID NO: 20734
  misc_feature 1..1683: note = derived and/or modified sequence opt2 from anti-influenza_Chain
  source 1..1683: mol_type = other RNA

SEQ ID NO: 20737 - RNA, 1683 nt, synthetic construct; identical to SEQ ID NO: 20730
  misc_feature 1..1683: note = derived and/or modified sequence opt2 from anti-influenza_Chain
  source 1..1683: mol_type = other RNA

SEQ ID NO: 20738 - RNA, 1683 nt, synthetic construct; identical to SEQ ID NO: 20731
  misc_feature 1..1683: note = derived and/or modified sequence opt2 from anti-influenza_Chain
  source 1..1683: mol_type = other RNA

SEQ ID NO: 20739 - RNA, 1701 nt, synthetic construct; identical to SEQ ID NO: 20735
  misc_feature 1..1701: note = derived and/or modified sequence opt2 from anti-influenza_Chain
  source 1..1701: mol_type = other RNA

SEQ ID NO: 20740 - RNA, 1701 nt, synthetic construct; identical to SEQ ID NO: 20732
  misc_feature 1..1701: note = derived and/or modified sequence opt2 from anti-influenza_Chain
  source 1..1701: mol_type = other RNA

SEQ ID NO: 20741 - RNA, 1701 nt, synthetic construct; identical to SEQ ID NO: 20733
  misc_feature 1..1701: note = derived and/or modified sequence opt2 from anti-influenza_Chain
  source 1..1701: mol_type = other RNA

SEQ ID NO: 20742 - RNA, 1704 nt, synthetic construct
  misc_feature 1..1704: note = derived and/or modified sequence opt2 from anti-influenza_Chain
  source 1..1704: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcctcaacgtccccgagtggtcctacatcgtcgagaagatcaaccccgccaacgacctctgctaccccggcgacttcaacgactacgaggagctcaagcacctcctctcccgcatcaaccacttcgagaagatccagatcatccccaagtcctcctggtccgactacgaggcctcctccggcgtctcctccgcctgcccctaccagggccgctcctccttcttccgcaacgtcgtctggctcatcaagaagaacaacgcctaccccaccatcaagcgctcctacaacaacaccaaccaggaggacctcctcgtcctctggggcatccaccaccccaacgacgccgccgagcagatccgcctctaccagaaccccaccacctacatctccatcggcacctccaccctcaaccagcgcctcgtccccaagatcgccacccgctccaaggtcaacggccagtccggccgcatggagttcttctggaccatcctcaagtccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatcggcgccatcaactcctccatgcccttccacaacatccaccccctcaccatcggcgagtgccccaagtacgtcaagtccaaccgcctcgtcctcgccaccggcctccgcaactccccccagggcgagcgccgccgccgcaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcaacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccaccgctgcgacaacgagtgcatggagtccgtccgcaacggcacctacgactacccccagtactccgaggaggcccgcctcaagcgcgaggagatctccggcgtcaagctcgagtccatgggcatctaccagatcctctccatctactccaccgtcgcctcctccctcgccctcgccatcatggtcgccggcctcttcctctggatgtgctccaacggctccctccagtgccgcatctgcatc

SEQ ID NO: 20743 - RNA, 1704 nt, synthetic construct
  misc_feature 1..1704: note = derived and/or modified sequence opt2 from anti-influenza_Chain
  source 1..1704: mol_type = other RNA
atggagaagatcgtcctcctcctcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccaccaacgacctctgctaccccggctccttcaacgactacgaggagctcaagcacctcctctcccgcatcaaccacttcgagaagatccagatcatccccaagtcctcctggtccgaccacgaggcctcctccggcgtctcctccgcctgcccctacctcggctccccctccttcttccgcaacgtcgtctggctcatcaagaagaactccacctaccccaccatcaagaagtcctacaacaacaccaaccaggaggacctcctcgtcctctggggcatccaccaccccaacgacgccgccgagcagacccgcctctaccagaaccccaccacctacatctccatcggcacctccaccctcaaccagcgcctcgtccccaagatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccgccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagtcccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccatccgcaacggcacctacaactacccccagtactccgaggaggcccgcctcaagcgcgaggagatctccggcgtcaagctcgagtccatcggcacctaccagatcctctccatctactccaccgtcgcctcctccctcgccctcgccatcatgatggccggcctctccctctggatgtgctccaacggctccctccagtgccgcatctgcatc

SEQ ID NO: 20744 - RNA, 1704 nt, synthetic construct
  misc_feature 1..1704: note = derived and/or modified sequence opt2 from anti-influenza_Chain
  source 1..1704: mol_type = other RNA
atggagaagatcgtcctcctcttcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgtcaacgacctctgctaccccggcgacttcaacgactacgaggagctcaagcacctcctctcccgcatcaaccacttcgagaagatccagatcatccccaagtcctcctggtcctcccacgaggcctccctcggcgtctcctccgcctgcccctaccagggcaagtcctccttcttccgcaacgtcgtctggctcatcaagaagaactccacctaccccaccatcaagcgctcctacaacaacaccaaccaggaggacctcctcgtcctctggggcatccaccaccccaacgacgccgccgagcagaccaagctctaccagaaccccaccacctacatctccgtcggcacctccaccctcaaccagcgcctcgtcccccgcatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatcctctccatctactccaccgtcgcctcctccctcgccctcgccatcatggtcgccggcctctccctctggatgtgctccaacggctccctccagtgccgcatctgcatc

SEQ ID NO: 20745 - RNA, 1704 nt, synthetic construct; identical to SEQ ID NO: 20742
  misc_feature 1..1704: note = derived and/or modified sequence opt2 from anti-influenza_Chain
  source 1..1704: mol_type = other RNA

SEQ ID NO: 20746 - RNA, 1704 nt, synthetic construct; identical to SEQ ID NO: 20743
  misc_feature 1..1704: note = derived and/or modified sequence opt2 from anti-influenza_Chain
  source 1..1704: mol_type = other RNA

SEQ ID NO: 20747 - RNA, 1704 nt, synthetic construct; identical to SEQ ID NO: 20744
  misc_feature 1..1704: note = derived and/or modified sequence opt2 from anti-influenza_Chain
  source 1..1704: mol_type = other RNA

SEQ ID NO: 20748 - RNA, 1707 nt, synthetic construct
  misc_feature 1..1707: note = derived and/or modified sequence opt2 from anti-influenza_Chain
  source 1..1707: mol_type = other RNA
tccaagtcccgcggctacaagatgaacacccagatcctcgtcttcgccctcgtcgcctccatccccaccaacgccgacaagatctgcctcggccaccacgccgtctccaacggcaccaaggtcaacaccctcaccgagcgcggcgtcgaggtcgtcaacgccaccgagaccgtcgagcgcaccaacgtcccccgcatctgctccaagggcaagcgcaccgtcgacctcggccagtgcggcctcctcggcaccatcaccggccccccccagtgcgaccagttcctcgagttctccgccgacctcatcatcgagcgccgcgagggctccgacgtctgctaccccggcaagttcgtcaacgaggaggccctccgccagatcctccgcgagtccggcggcatcgacaaggagaccatgggcttcacctactccggcatccgcaccaacggcaccacctccgcctgccgccgctccggctcctccttctacgccgagatgaagtggctcctctccaacaccgacaacgccgccttcccccagatgaccaagtcctacaagaacacccgcaaggaccccgccctcatcatctggggcatccaccactccggctccaccaccgagcagaccaagctctacggctccggcaacaagctcatcaccgtcggctcctccaactaccagcagtccttcgtcccctcccccggcgcccgcccccaggtcaacggccagtccggccgcatcgacttccactggctcatcctcaaccccaacgacaccgtcaccttctccttcaacggcgccttcatcgcccccgaccgcgcctccttcctccgcggcaagtccatgggcatccagtccgaggtccaggtcgacgccaactgcgagggcgactgctaccactccggcggcaccatcatctccaacctccccttccagaacatcaactcccgcgccgtcggcaagtgcccccgctacgtcaagcaggagtccctcctcctcgccaccggcatgaagaacgtccccgagatccccaagcgccgccgccgcggcctcttcggcgccatcgccggcttcatcgagaacggctgggagggcctcatcgacggctggtacggcttccgccaccagaacgcccagggcgagggcaccgccgccgactacaagtccacccagtccgccatcgaccagatcaccggcaagctcaaccgcctcatcgagaagaccaaccagcagttcgagctcatcgacaacgagttcaccgaggtcgagcgccagatcggcaacgtcatcaactggacccgcgactccatgaccgaggtctggtcctacaacgccgagctcctcgtcgccatggagaaccagcacaccatcgacctcgccgactccgagatgaacaagctctacgagcgcgtcaagcgccagctccgcgagaacgccgaggaggacggcaccggctgcttcgagatcttccacaagtgcgacgacgactgcatggcctccatccgcaacaacacctacgaccactccaagtaccgcgaggaggccatccagaaccgcatccagatcgaccccgtcaagctctcctccggctacaaggacgtcatcctctggttctccttcggcgcctcctgcttcatcctcctcgccatcgccatgggcctcgtcttcatctgcgtcaagaacggcaacatgcgctgcaccatctgcatc

SEQ ID NO: 20749 - RNA, 1707 nt, synthetic construct; identical to SEQ ID NO: 20748
  misc_feature 1..1707: note = derived and/or modified sequence opt2 from anti-influenza_Chain
  source 1..1707: mol_type = other RNA

SEQ ID NO: 20750 - RNA, 1692 nt, synthetic construct
  misc_feature 1..1692: note = derived and/or modified sequence opt2 from anti-influenza_Chain
  source 1..1692: mol_type = other RNA
gaccagatctgcatcggctaccacgccaacaactccaccgagaaggtcgacaccaacctcgagcgcaacgtcaccgtcacccacgccaaggacatcctcgagaagacccacaacggcaagctctgcaagctcaacggcatcccccccctcgagctcggcgactgctccatcgccggctggctcctcggcaaccccgagtgcgaccgcctcctctccgtccccgagtggtcctacatcatggagaaggagaacccccgcgacggcctctgctaccccggctccttcaacgactacgaggagctcaagcacctcctctcctccgtcaagcacttcgagaaggtcaagatcctccccaaggaccgctggacccagcacaccaccaccggcggctcccgcgcctgcgccgtctccggcaacccctccttcttccgcaacatggtctggctcaccaaggagggctccgactaccccgtcgccaagggctcctacaacaacacctccggcgagcagatgctcatcatctggggcgtccaccaccccatcgacgagaccgagcagcgcaccctctaccagaacgtcggcacctacgtctccgtcggcacctccaccctcaacaagcgctccacccccgagatcgccacccgccccaaggtcaacggccagggcggccgcatggagttctcctggaccctcctcgacatgtgggacaccatcaacttcgagtccaccggcaacctcatcgcccccgagtacggcttcaagatctccaagcgcggctcctccggcatcatgaagaccgagggcaccctcgagaactgcgagaccaagtgccagacccccctcggcgccatcaacaccaccctccccttccacaacgtccaccccctcaccatcggcgagtgccccaagtacgtcaagtccgagaagctcgtcctcgccaccggcctccgcaacgtcccccagatcgagtcccgcggcctcttcggcgccatcgccggcttcatcgagggcggctggcagggcatggtcgacggctggtacggctaccaccactccaacgaccagggctccggctacgccgccgacaaggagtccacccagaaggccttcgacggcatcaccaacaaggtcaactccgtcatcgagaagatgaacacccagttcgaggccgtcggcaaggagttcggcaacctcgagcgccgcctcgagaacctcaacaagcgcatggaggacggcttcctcgacgtctggacctacaacgccgagctcctcgtcctcatggagaacgagcgcaccctcgacttccacgactccaacgtcaagaacctctacgacaaggtccgcatgcagctccgcgacaacgtcaaggagctcggcaacggctgcttcgagttctaccacaagtgcgacgacgagtgcatgaactccgtcaagaacggcacctacgactaccccaagtacgaggaggagtccaagctcaaccgcaacgagatcaagggcgtcaagctctcctccatgggcgtctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20751 - RNA, 1692 nt, synthetic construct
  misc_feature 1..1692: note = derived and/or modified sequence opt2 from anti-influenza_Chain
  source 1..1692: mol_type = other RNA
cagaagctccccggcaacgacaactccaccgccaccctctgcctcggccaccacgccgtccccaacggcaccatcgtcaagaccatcaccaacgaccagatcgaggtcaccaacgccaccgagctcgtccagtcctcctccaccggcggcatctgcgactccccccaccagatcctcgacggcgagaactgcaccctcatcgacgccctcctcggcgacccccagtgcgacggcttccagaacaagaagtgggacctcttcgtcgagcgctccaaggcctactccaactgctacccctacgacgtccccgactacgcctccctccgctccctcgtcgcctcctccggcaccctcgagttcaacgacgagtccttcaactggaccggcgtcacccagaacggcacctcctcctcctgcaagcgccgctccaacaactccttcttctcccgcctcaactggctcacccagctcaagttcaagtaccccgccctcaacgtcaccatgcccaacaacgagaagttcgacaagctctacatctggggcgtccaccaccccgtcaccgacaacgaccagatcttcctctacgcccaggcctccggccgcatcaccgtctccaccaagcgctcccagcagaccgtcatccccaacatcggctcccgcccccgcatccgcaacatcccctcccgcatctccatctactggaccatcgtcaagcccggcgacatcctcctcatcaactccaccggcaacctcatcgccccccgcggctacttcaagatccgctccggcaagtcctccatcatgcgctccgacgcccccatcggcaagtgcaactccgagtgcatcacccccaacggctccatccccaacgacaagcccttccagaacgtcaaccgcatcacctacggcgcctgcccccgctacgtcaagcagaacaccctcaagctcgccaccggcatgcgcaacgtccccgagaagcagacccgcggcatcttcggcgccatcgccggcttcatcgagaacggctgggagggcatggtcgacggctggtacggcttccgccaccagaactccgagggcatcggccaggccgccgacctcaagtccacccaggccgccatcaaccagatcaacggcaagctcaaccgcctcatcggcaagaccaacgagaagttccaccagatcgagaaggagttctccgaggtcgagggccgcatccaggacctcgagaagtacgtcgaggacaccaagatcgacctctggtcctacaacgccgagctcctcgtcgccctcgagaaccagcacaccatcgacctcaccgactccgagatgaacaagctcttcgagcgcaccaagaagcagctccgcgagaacgccgaggacatgggcaacggctgcttcaagatctaccacaagtgcgacaacgcctgcatcggctccatccgcaacggcacctacgaccacgacgtctaccgcgacgaggccctcaacaaccgcttccagatcaagggcgtcgagctcaagtccggctccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20752 - RNA, 1692 nt, synthetic construct; identical to SEQ ID NO: 20750
  misc_feature 1..1692: note = derived and/or modified sequence opt2 from anti-influenza_Chain
  source 1..1692: mol_type = other RNA

SEQ ID NO: 20753 - RNA, 1692 nt, synthetic construct; identical to SEQ ID NO: 20751
  misc_feature 1..1692: note = derived and/or modified sequence opt2 from anti-influenza_Chain
  source 1..1692: mol_type = other RNA

SEQ ID NO: 20754 - RNA, 1695 nt, synthetic construct
  misc_feature 1..1695: note = derived and/or modified sequence opt2 from anti-influenza_Chain
  source 1..1695: mol_type = other RNA
gacaccatctgcatcggctaccacgccaacaactccaccgacaccgtcgacaccgtcctcgagaagaacgtcaccgtcacccactccgtcaacctcctcgaggactcccacaacggcaagctctgcctcctcaagggcatcgcccccctccagctcggcaactgctccgtcgccggctggatcctcggcaaccccgagtgcgagctcctcatctcccgcgagtcctggtcctacatcgtcgagaagcccaaccccgagaacggcacctgctaccccggccacttcgccgactacgaggagctccgcgagcagctctcctccgtctcctccttcgagcgcttcgagatcttccccaaggagtcctcctggcccaaccacaccaccaccggcgtctccgcctcctgctcccacaacggcgagtcctccttctacaagaacctcctctggctcaccggcaagaacggcctctaccccaacctctccaagtcctacgccaacaacaaggagaaggaggtcctcgtcctctggggcgtccaccacccccccaacatcggcgaccagcgcgccctctaccacaaggagaacgcctacgtctccgtcgtctcctcccactactcccgcaagttcacccccgagatcgccaagcgccccaaggtccgcgaccaggagggccgcatcaactactactggaccctcctcgagcccggcgacaccatcatcttcgaggccaacggcaacctcatcgccccccgctacgccttcgccctctcccgcggcttcggctccggcatcatcaactccaacgcccccatggacgagtgcgacgccaagtgccagaccccccagggcgccatcaactcctccctccccttccagaacgtccaccccgtcaccatcggcgagtgccccaagtacgtccgctccgccaagctccgcatggtcaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgaccagaagtccacccagaacgccatcaacggcatcaccaacaaggtcaactccgtcatcgagaagatgaacacccagttcaccgccgtcggcaaggagttcaacaagctcgagcgccgcatggagaacctcaacaagaaggtcgacgacggcttcatcgacatctggacctacaacgccgagctcctcgtcctcctcgagaacgagcgcaccctcgacttccacgactccaacgtcaagaacctctacgagaaggtcaagtcccagctcaagaacaacgccaaggagatcggcaacggctgcttcgagttctaccacaagtgcaacgacgagtgcatggagtccgtcaagaacggcacctacgactaccccaagtactccgaggagtccaagctcaaccgcgagaagatcgacggcgtcaagctcgagtccatgggcgtctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20755 - RNA, 1695 nt, synthetic construct
  misc_feature 1..1695: note = derived and/or modified sequence opt2 from anti-influenza_Chain
  source 1..1695: mol_type = other RNA
cagaactacaccggcaaccccgtcatctgcctcggccaccacgccgtctccaacggcaccatggtcaagaccctcaccgacgaccagatcgaggtcgtcaccgcccaggagctcgtcgagtcccagcacctccccgagctctgcccctcccccctccgcctcgtcgacggccagacctgcgacatcgtcaacggcgccctcggctcccccggctgcgaccacctcaacggcgccgagtgggacgtcttcatcgagcgccccaccgccgtcgacacctgctaccccttcgacgtccccgactaccagtccctccgctccatcctcgccaacaacggcaagttcgagttcatcgccgaggagttccagtggaacaccgtcaagcagaacggcaagtccggcgcctgcaagcgcgccaacgtcaacgacttcttcaaccgcctcaactggctcaccaagtccgacggcaacgcctaccccctccagaacctcaccaaggtcaacaacggcgactacgcccgcctctacatctggggcgtccaccacccctccaccgacaccgagcagaccaacctctacaagaacaaccccggccgcgtcaccgtctccacccagacctcccagacctccgtcgtccccaacatcggctcccgcccctgggtccgcggcctctcctcccgcatctccttctactggaccatcgtcgagcccggcgacctcatcgtcttcaacaccatcggcaacctcatcgccccccgcggccactacaagctcaactcccagaagaagtccaccatcctcaacaccgccgtccccatcggctcctgcgtctccaagtgccacaccgacaagggctccatctccaccaccaagcccttccagaacatctcccgcatctccatcggcgactgccccaagtacgtcaagcagggctccctcaagctcgccaccggcatgcgctccatcctcgagaaggccacccgcggcctcttcggcgccatcgccggcttcatcgagaacggctggcagggcctcatcgacggctggtacggcttccgccaccagaacgccgagggcaccggcaccgccgccgacctcaagtccacccaggccgccatcgaccagatcaacggcaagctcaaccgcctcatcggcaagcccaacgagaagtaccaccagatcgagaaggagttcgagcaggtcgagggccgcatccaggacctcgagaagtacgtcgaggacaccaagatcgacctctggtcctacaacgccgagctcctcgtcgccctcgagaaccagcacaccatcgacgtcaccgactccgagatgaacaagctcttcgagcgcgtccgccaccagctccgcgagaacgccgaggacaagggcaacggctgcttcgagatcttccaccagtgcgacaactcctgcatcgagtccatccgcaacggcacctacgaccacgacatctaccgcgacgaggccatcaacaaccgcttccagatccagggcgtcaagctcatccagggctacaaggactccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20756 - RNA, 1695 nt, synthetic construct
  misc_feature 1..1695: note = derived and/or modified sequence opt2 from anti-influenza_Chain
  source 1..1695: mol_type = other RNA
gaccagatctgcatcggctaccacgccaacaactccaccgagcaggtcgacaccatcatggagaagaacgtcaccgtcacccacgcccaggacatcctcgagaagacccacaacggcaagctctgcaacctcgacggcgtcaagcccctcatcctcaaggactgctccgtcgccggctggctcctcggcaaccccatgtgcgacgagttcctcaacgtctccgagtggtcctacatcgtcgagaaggcctcccccgccaacggcctctgctaccccggcgacttcaacgactacgaggagctcaagcacctcctctcccgcatcaaccacctcaagaagatcaagatcatccccaagtcctactggtccaaccacgaggcctcctccggcgtctccgccgcctgctcctacctcggcgagccctccttcttccgcaacgtcgtctggctcatcaagaagaacaacacctacccccccatcaaggtcaactacaccaacaccaaccaggaggacctcctcgtcctctggggcatccaccaccccaacgacgagaaggagcagatccgcatctaccagaaccccaacacctccatctccgtcggcacctccaccctcaaccagcgcctcgtccccaagatcgccacccgccccaaggtcaacggccagtccggccgcatggagttcttctggaccatcctcaagcccaacgactccatcaacttcgactccaacggcaacttcatcgcccccgagtacgcctacaagatcgccaagaagggcgactccgtcatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaacgccccccagaccgagacccgcggcctcttcggcgccatcgccggcttcatcgagggcggctggcagggcatggtcgacggctggtacggctaccaccactccaacgagcagggctccggctacgccgccgacaaggagtccacccagaaggccatcgacggcatcaccaacaaggtcaactccatcatcgacaagatgaacacccagttcgagatcgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgagaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctctcccgcgaggagatctccggcgtcaagatggagtccatggtcacctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20757 - RNA, 1695 nt, synthetic construct; identical to SEQ ID NO: 20754
  misc_feature 1..1695: note = derived and/or modified sequence opt2 from anti-influenza_Chain
  source 1..1695: mol_type = other RNA

SEQ ID NO: 20758 - RNA, 1695 nt, synthetic construct; identical to SEQ ID NO: 20755
  misc_feature 1..1695: note = derived and/or modified sequence opt2 from anti-influenza_Chain
  source 1..1695: mol_type = other RNA

SEQ ID NO: 20759 - RNA, 1695 nt, synthetic construct; identical to SEQ ID NO: 20756
  misc_feature 1..1695: note = derived and/or modified sequence opt2 from anti-influenza_Chain
  source 1..1695: mol_type = other RNA

SEQ ID NO: 20760 - RNA, 1698 nt, synthetic construct
  misc_feature 1..1698: note = derived and/or modified sequence opt2 from anti-influenza_Chain
  source 1..1698: mol_type = other RNA
gacaccctctgcatcggctaccacgccaacaactccaccgacaccgtcgacaccgtcctcgagaagaacgtcaccgtcacccactccgtcaacctcctcgaggacaagcacaacggcaagctctgcaagctccgcggcgtcgcccccctccacctcggcaagtgcaacatcgccggctggatcctcggcaaccccgagtgcgagtccctctccaccgcctcctcctggtcctacatcgtcgagaccccctcctccgacaacggcacctgctaccccggcgacttcatcgactacgaggagctccgcgagcagctctcctccgtctcctccttcgagcgcttcgagatcttccccaagacctcctcctggcccaaccacgactccaacaagggcgtcaccgccgcctgcccccacgccggcgccaagtccttctacaagaacctcatctggctcgtcaagaagggcaactcctaccccaagctctccaagtcctacatcaacgacaagggcaaggaggtcctcgtcctctggggcatccaccacccctccacctccgccgaccagcagtccctctaccagaacgccgacacctacgtcttcgtcggctcctcccgctactccaagaagttcaagcccgagatcgccatccgccccaaggtccgcgaccaggagggccgcatgaactactactggaccctcgtcgagcccggcgacaagatcaccttcgaggccaccggcaacctcgtcgtcccccgctacgccttcgccatggagcgcaacgccggctccggcatcatcatctccgacacccccgtccacgactgcaacaccacctgccagacccccaagggcgccatcaacacctccctccccttccagaacatccaccccatcaccatcggcaagtgccccaagtacgtcaagtccaccaagctccgcctcgccaccggcctccgcaacatcccctccatccagtcccgcggcctcttcggcgccatcgccggcttcatcgagggcggctggaccggcatggtcgacggctggtacggctaccaccaccagaacgagcagggctccggctacgccgccgacctcaagtccacccagaacgccatcgacgagatcaccaacaaggtcaactccgtcatcgagaagatgaacacccagttcaccgccgtcggcaaggagttcaaccacctcgagaagcgcatcgagaacctcaacaagaaggtcgacgacggcttcctcgacatctggacctacaacgccgagctcctcgtcctcctcgagaacgagcgcaccctcgactaccacgactccaacgtcaagaacctctacgagaaggtccgctcccagctcaagaacaacgccaaggagatcggcaacggctgcttcgagttctaccacaagtgcgacaacacctgcatggagtccgtcaagaacggcacctacgactaccccaagtactccgaggaggccaagctcaaccgcgaggagatcgacggcgtcaagctcgagtccacccgcatctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20761 - RNA, 1698 nt, synthetic construct
  misc_feature 1..1698: note = derived and/or modified sequence opt2 from anti-influenza_Chain
  source 1..1698: mol_type = other RNA
gaccgcatctgcatcggctaccagtccaacaactccaccgacaccgtcaacaccctcatcgagcagaaggtccccgtcacccagaccatggagctcgtcgagaccgagaagcaccccgcctactgcaacaccgacctcggcgcccccctcgagctccgcgactgcaagatcgaggccgtcatctacggcaaccccaagtgcgacatccacctcaaggaccagggctggtcctacatcgtcgagcgcccctccgcccccgagggcatgtgctaccccggctccgtcgagaacctcgaggagctccgcttcgtcttctcctccgccgcctcctacaagcgcatccgcctcttcgactactcccgctggaacgtcacctcctccggcacctccaaggcctgcaacgcctccaccggcggccagtccttctaccgctccatcaactggctcaccaagaagaagcccgacacctacgacttcaacgagggcacctacgtcaacaacgaggacggcgacatcatcttcctctggggcatccaccacccccccgacaccaaggagcagaccaccctctacaagaacgccaacaccctctcctccgtcaccaccaacaccatcaaccgctccttccagcccaacatcggcccccgccccctcgtccgcggccagcagggccgcatggactactactggggcatcctcaagcgcggcgagaccctcaagatccgcaccaacggcaacctcatcgcccccgagttcggctacctcctcaagggcgagtcccacggccgcaccatccagaacgaggacatccccatcggcaactgctacaccaagtgccagacctacgccggcgccatcaactcctccaagcccttccagaacgcctcccgccactacatgggcgagtgccccaagtacgtcaagaaggcctccctccgcctcgccgtcggcctccgcaacaccccctccgtcgagccccgcggcctcttcggcgccatcgccggcttcatcgagggcggctggtccggcatgatcgacggctggtacggcttccaccactccaactccgagggcaccggcatggccgccgaccagaagtccacccaggaggccatcgacaagatcaccaacaaggtcaacaacatcgtcgacaagatgaaccgcgagttcgaggtcgtcaaccacgagttctccgaggtcgagaagcgcatcaacatgatcaacgacaagatcgacgaccagatcgaggacctctgggcctacaacgccgagctcctcgtcctcctcgagaaccagaagaccctcgacgagcacgactccaacgtcaagaacctcttcgacgaggtcaagcgccgcctctccgccaacgccatcgacgccggcaacggctgcttcgacatcctccacaagtgcgacaacgagtgcatggagaccatcaagaacggcacctacgaccacaaggagtacgaggaggaggccaagctcgagcgctccaagatcaacggcgtcaagctcgaggagaacaccacctacaagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20762 - RNA, 1698 nt, synthetic construct; identical to SEQ ID NO: 20760
  misc_feature 1..1698: note = derived and/or modified sequence opt2 from anti-influenza_Chain
  source 1..1698: mol_type = other RNA

SEQ ID NO: 20763 - RNA, 1698 nt, synthetic construct; identical to SEQ ID NO: 20761
  misc_feature 1..1698: note = derived and/or modified sequence opt2 from anti-influenza_Chain
  source 1..1698: mol_type = other RNA

SEQ ID NO: 20764 - RNA, 1701 nt, synthetic construct
  misc_feature 1..1701: note = derived and/or modified sequence opt2 from anti-influenza_Chain
  source 1..1701: mol_type = other RNA
gacaagatctgcatcggctaccacgccaacaactccaccacccaggtcgacaccatcctcgagaagaacgtcaccgtcacccactccgtcgagctcctcgagaaccagaaggaggagcgcttctgcaagatcctcaacaaggcccccctcgacctccgcggctgcaccatcgagggctggatcctcggcaacccccagtgcgacctcctcctcggcgaccagtcctggtcctacatcgtcgagcgccccaccgcccagaacggcatctgctaccccggcgccctcaacgaggtcgaggagctcaaggccctcatcggctccggcgagcgcgtcgagcgcttcgagatgttccccaagtccacctggaccggcgtcgacacctcctccggcgtcaccaaggcctgcccctacaactccggctcctccttctaccgcaacctcctctggatcatcaagaccaagtccgccgcctaccccgtcatcaagggcacctacaacaacaccggctcccagcccatcctctacttctggggcgtccaccacccccccgacaccaacgagcagaacaccctctacggctccggcgaccgctacgtccgcatgggcaccgagtccatgaacttcgccaagtcccccgagatcgccgcccgccccgccgtcaacggccagcgcggccgcatcgactactactggtccgtcctcaagcccggcgagaccctcaacgtcgagtccaacggcaacctcatcgccccctggtacgcctacaagttcgtctccaccaacaacaagggcgccatcttcaagtccaacctccccatcgagaactgcgacgccacctgccagaccatcgccggcgtcctccgcaccaacaagaccttccagaacgtctcccccctctggatcggcgagtgccccaagtacgtcaagtccgagtccctccgcctcgccaccggcctccgcaacgtcccccagatcgagacccgcggcctcttcggcgccatcgccggcttcatcgagggcggctggaccggcatgatcgacggctggtacggctaccaccacgagaactcccagggctccggctacgccgccgacaaggagtccacccagaaggccatcgacggcatcaccaacaaggtcaactccatcatcgacaagatgaacacccagttcgaggccgtcgaccacgagttctccaacctcgagcgccgcatcgacaacctcaacaagcgcatggaggacggcttcctcgacgtctggacctacaacgccgagctcctcgtcctcctcgagaacgagcgcaccctcgacctccacgacgccaacgtcaagaacctctacgagaaggtcaagtcccagctccgcgacaacgccaacgacctcggcaacggctgcttcgagttctggcacaagtgcgacaacgagtgcatcgagtccgtcaagaacggcacctacgactaccccaagtaccaggacgagtccaagctcaaccgccaggagatcgagtccgtcaagctcgacaacctcggcgtctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20765 - RNA, 1701 nt, synthetic construct; identical to SEQ ID NO: 20764
  misc_feature 1..1701: note = derived and/or modified sequence opt2 from anti-influenza_Chain
  source 1..1701: mol_type = other RNA

SEQ ID NO: 20766 - RNA, 1704 nt, synthetic construct
  misc_feature 1..1704: note = derived and/or modified sequence opt2 from anti-influenza_Chain
  source 1..1704: mol_type = other RNA
gaccacatctgcatcggctaccacgccaacaactccaccgagcaggtcgacaccatcatggagaagaacgtcaccgtcacccacgcccaggacatcctcgagaagacccacaacggcaagctctgcgacctcaacggcgtcaagcccctcatcctcaaggactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaaggactcctggtccgaccacgaggcctccctcggcgtctcctccgcctgcccctaccagggcaactcctccttcttccgcaacgtcgtctggctcatcaagaagggcaacgcctaccccaccatcaagaagtcctacaacaacaccaaccaggaggacctcctcgtcctctggggcatccaccaccccaacgacgaggccgagcagacccgcctctaccagaaccccaccacctacatctccatcggcacctccaccctcaaccagcgcctcgtccccaagatcgccacccgctccaaggtcaacggccagtccggccgcatcgacttcttctggaccatcctcaagcccaacgacgccatcaacttcgagtccaacggcaacttcatcgcccccgagtacgcctacaagatcgtcaagaagggcgactccaccatcatgaagtccgaggtcgagtacggcaactgcaacacccgctgccagacccccatgggcgccatcaactcctccatgcccttccacaacatccaccccctcaccatcggcgagtgccccaagtacgtcaagtccaacaagctcgtcctcgccaccggcctccgcaactccccccagcgcgagcgccgccgcaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcacctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20767 - RNA, 1704 nt, synthetic construct
  misc_feature 1..1704: note = derived and/or modified sequence opt2 from anti-influenza_Chain
  source 1..1704: mol_type = other RNA
gaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagtccggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctccgcgagcgccgccgcaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcacctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20768 - RNA, 1704 nt, synthetic construct; identical to SEQ ID NO: 20766
  misc_feature 1..1704: note = derived and/or modified sequence opt2 from anti-influenza_Chain
  source 1..1704: mol_type = other RNA

SEQ ID NO: 20769 - RNA, 1704 nt, synthetic construct; identical to SEQ ID NO: 20767
  misc_feature 1..1704: note = derived and/or modified sequence opt2 from anti-influenza_Chain
  source 1..1704: mol_type = other RNA

SEQ ID NO: 20770 - RNA, 1707 nt, synthetic construct
  misc_feature 1..1707: note = derived and/or modified sequence opt2 from anti-influenza_Chain
  source 1..1707: mol_type = other RNA
gaccagatctgcatcggctaccacgccaacaactccaccgagcaggtcgacaccatcatggagaagaacgtcaccgtcacccacgcccaggacatcctcgagaagaagcacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgtcaacgacctctgctaccccggcgacttcaacgactacgaggagctcaagcacctcctctcccgcatcaaccacttcgagaagatccagatcatccccaagtcctcctggtcctcccacgaggcctccctcggcgtctcctccgcctgcccctaccagggcaagtcctccttcttccgcaacgtcgtctggctcatcaagaagaactccacctaccccaccatcaagcgctcctacaacaacaccaaccaggaggacctcctcgtcctctggggcatccaccaccccaacgacgccgccgagcagaccaagctctaccagaaccccaccacctacatctccgtcggcacctccaccctcaaccagcgcctcgtcccccgcatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20771 - RNA, 1707 nt, synthetic construct
  misc_feature 1..1707: note = derived and/or modified sequence opt2 from anti-influenza_Chain
  source 1..1707: mol_type = other RNA
gaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccaccaacgacctctgctaccccggctccttcaacgactacgaggagctcaagcacctcctctcccgcatcaaccacttcgagaagatccagatcatccccaagtcctcctggtccgaccacgaggcctcctccggcgtctcctccgcctgcccctacctcggctccccctccttcttccgcaacgtcgtctggctcatcaagaagaactccacctaccccaccatcaagaagtcctacaacaacaccaaccaggaggacctcctcgtcctctggggcatccaccaccccaacgacgccgccgagcagacccgcctctaccagaaccccaccacctacatctccatcggcacctccaccctcaaccagcgcctcgtccccaagatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccgccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagtcccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccatccgcaacggcacctacaactacccccagtactccgaggaggcccgcctcaagcgcgaggagatctccggcgtcaagctcgagtccatcggcacctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20772 - RNA, 1707 nt, synthetic construct
  misc_feature 1..1707: note = derived and/or modified sequence opt2 from anti-influenza_Chain
  source 1..1707: mol_type = other RNA
gaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcctcaacgtctccgagtggtcctacatcgtcgagaagatcaaccccgccaacgacctctgctaccccggcaacttcaacaactacgaggagctcaagcacctcctctcccgcatcaaccgcttcgagaagatccagatcatccccaagtcctcctggcccgaccacgaggcctccctcggcgtctcctccgcctgcccctaccagggcggcccctccttctaccgcaacgtcgtctggctcatcaagaagaacaacacctaccccaccatcaagaagtcctaccacaacaccaaccaggaggacctcctcgtcctctggggcatccaccaccccaacgacgaggccgagcagacccgcatctacaagaaccccaccacctacatctccgtcggcacctccaccctcaaccagcgcctcgtccccaagatcgccacccgctccaaggtcaacggccagtccggccgcgtcgagttcttctggaccatcctcaagtccaacgacaccatcaacttcgagtccaacggcaacttcatcgcccccgagaacgcctacaagatcgtcaagaagggcgactccaccatcatgaagtccgagctcgagtacggcaactgcaacaccaagtgccagacccccatcggcgccatcaactcctccatgcccttccacaacatccaccccctcaccatcggcgagtgccccaagtacgtcaagtccaaccgcctcgtcctcgccaccggcctccgcaactccccccagggcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccaccgctgcgacaacgagtgcatggagtccgtccgcaacggcacctacgactacccccagtactccgaggaggcccgcctcaagcgcgaggagatctccggcgtcaagctcgagtccatcggcacctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20773 - RNA, 1707 nt, synthetic construct; identical to SEQ ID NO: 20770
  misc_feature 1..1707: note = derived and/or modified sequence opt2 from anti-influenza_Chain
  source 1..1707: mol_type = other RNA

SEQ ID NO: 20774 - RNA, 1707 nt, synthetic construct; identical to SEQ ID NO: 20771
  misc_feature 1..1707: note = derived and/or modified sequence opt2 from anti-influenza_Chain
  source 1..1707: mol_type = other RNA

SEQ ID NO: 20775 - RNA, 1707 nt, synthetic construct; identical to SEQ ID NO: 20772
  misc_feature 1..1707: note = derived and/or modified sequence opt2 from anti-influenza_Chain
  source 1..1707: mol_type = other RNA

SEQ ID NO: 20776 - RNA, 1728 nt, synthetic construct
  misc_feature 1..1728: note = derived and/or modified sequence opt2 from anti-influenza_Chain
  source 1..1728: mol_type = other RNA
atctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgccaacgacctctgctaccccggcaacttcaacgactacgaggagctcaagcacctcctctcccgcatcaaccacttcgagaagatccagatcatccccaagtcctcctggtccgaccacgaggcctcctccggcgtctcctccgcctgcccctaccagggcaccccctccttcttccgcaacgtcgtctggctcatcaagaagaacaacacctaccccaccatcaagcgctcctacaacaacaccaaccaggaggacctcctcatcctctggggcatccaccactccaacgacgccgccgagcagaccaagctctaccagaaccccaccacctacatctccgtcggcacctccaccctcaaccagcgcctcgtccccaagatcgccacccgctccaaggtcaacggccagaacggccgcatggacttcttctggaccatcctcaagcccaacgacgccatcaacttcgagtccaacggcaacttcatcgcccccgagtacgcctacaagatcgtcaagaagggcgactccgccatcgtcaagtccgaggtcgagtacggcaactgcaacaccaagtgccagacccccatcggcgccatcaactcctccatgcccttccacaacatccaccccctcaccatcggcgagtgccccaagtacgtcaagtccaacaagctcgtcctcgccaccggcctccgcaactcccccctcggctacatccccgaggccccccgcgacggccaggcctacgtccgcaaggacggcgagtgggtcctcctctccaccttcctccgctccgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20777 - RNA, 1728 nt, synthetic construct
  misc_feature 1..1728: note = derived and/or modified sequence opt2 from anti-influenza_Chain
  source 1..1728: mol_type = other RNA
atggtcgtcacctccaacgccgaccgcatctgcaccggcatcacctcctccaactccccccacgtcgtcaagaccgccacccagggcgaggtcaacgtcaccggcgtcatccccctcaccaccacccccaccaagtcccacttcgccaacctcaagggcaccgagacccgcggcaagctctgccccaagtgcctcaactgcaccgacctcgacgtcgccctcggccgccccaagtgcaccggcaacatcccctccgcccgcgtctccatcctccacgaggtccgccccgtcacctccggctgcttccccatcatgcacgaccgcaccaagatccgccagctccccaacctcctccgcggctacgagcacatccgcctctccacccacaacgtcatcaacgccgagaacgcccccggcggcccctacaagatcggcacctccggctcctgccccaacgtcaccaacggcaacggcttcttcgccaccatggcctgggccgtccccaagaacgacaacaacaagaccgccaccaactccctcaccatcgaggtcccctacatctgcaccgagggcgaggaccagatcaccgtctggggcttccactccgacaacgagacccagatggccaagctctacggcgactccaagccccagaagttcacctcctccgccaacggcgtcaccacccactacgtctcccagatcggcggcttccccaaccagaccgaggacggcggcctcccccagtccggccgcatcgtcgtcgactacatggtccagaagtccggcaagaccggcaccatcacctaccagcgcggcatcctcctcccccagaaggtctggtgcgcctccggcaagtccaaggtcatcaagggctccctccccctcatcggcgaggccgactgcctccacgagaagtacggcggcctcaacaagtccaagccctactacaccggcgagcacgccaaggccatcggcaactgccccatctgggtcaagacccccctcaagctcgccaacggcaccaagtaccgcccccccgccaagctcctcaaggagcgcggcttcttcggcgccatcgccggcttcctcgagggcggctgggagggcatgatcgccggctggcacggctacacctcccacggcgcccacggcgtcgccgtcgccgccgacctcaagtccacccaggaggccatcaacaagatcaccaagaacctcaactccctctccgagctcgaggtcaagaacctccagcgcctctccggcgccatggacgagctccacaacgagatcctcgagctcgacgagaaggtcgacgacctccgcgccgacaccatctcctcccagatcgagctcgccgtcctcctctccaacgagggcatcatcaactccgaggacgagcacctcctcgccctcgagcgcaagctcaagaagatgctcggcccctccgccgtcgagatcggcaacggctgcttcgagaccaagcacaagtgcaaccagacctgcctcgaccgcatcgccgccggcaccttcgacgccggcgagttctccctccccaccttcgactccctcaacatcaccgccgcctccctcaacgacgacggcctcgacaaccacaccatcctcctctactactccaccgccgcctcctccctcgccgtcaccctcatgatcgccatcttcgtcgtctacatggtctcccgcgacaacgtctcctgcttccactcc

SEQ ID NO: 20778 - RNA, 1728 nt, synthetic construct; identical to SEQ ID NO: 20777
  misc_feature 1..1728: note = derived and/or modified sequence opt2 from anti-influenza_Chain
  source 1..1728: mol_type = other RNA

SEQ ID NO: 20779 - RNA, 1728 nt, synthetic construct; identical to SEQ ID NO: 20776
  misc_feature 1..1728: note = derived and/or modified sequence opt2 from anti-influenza_Chain
  source 1..1728: mol_type = other RNA

SEQ ID NO: 20780 - RNA, 1731 nt, synthetic construct
  misc_feature 1..1731: note = derived and/or modified sequence opt2 from anti-influenza_Chain
  source 1..1731: mol_type = other RNA
gccaaggccggcgtccagtccgtcaagatggagaagatcgtcctcctcttcgccatcgtctccctcgtcaagtccgaccagatctgcatcggctaccacgccaacaactccaccgagcaggtcgacaccatcatggagaagaacgtcaccgtcacccacgcccaggacatcctcgagaagacccacaacggcaagctctgcgacctcgacggcgtcaagcccctcatcctccgcgactgctccgtcgccggctggctcctcggcaaccccatgtgcgacgagttcatcaacgtccccgagtggtcctacatcgtcgagaaggccaaccccgtcaacgacctctgctaccccggcgacttcaacgactacgaggagctcaagcacctcctctcccgcatcaaccacttcgagaagatccagatcatccccaagtcctcctggtcctcccacgaggcctccctcggcgtctcctccgcctgcccctaccagggcaagtcctccttcttccgcaacgtcgtctggctcatcaagaagaactccacctaccccaccatcaagcgctcctacaacaacaccaaccaggaggacctcctcgtcctctggggcatccaccaccccaacgacgccgccgagcagaccaagctctaccagaaccccaccacctacatctccgtcggcacctccaccctcaaccagcgcctcgtcccccgcatcgccacccgctccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaactccccccagcgcgagcgccgccgcaagaagcgcggcctcttcggcgccatcgccggcttcatcgagggcggctggcagggcatggtcgacggctggtacggctaccaccactccaacgagcagggctccggctacgccgccgacaaggagtccacccagaaggccatcgacggcgtcaccaacaaggtcaactccatcatcgacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtccgcaacggcacctacgactacccccagtactccgaggaggcccgcctcaagcgcgaggagatctccggcgtcaagctcgagtccatcggcatctaccagatcctctccatctactccaccgtcgcctcctccctcgccctcgccctcatggtcgccggcctctccctctggatgtgctccaacggctccctccagtgccgcatctgcatc

SEQ ID NO: 20781 - RNA, 1731 nt, synthetic construct; identical to SEQ ID NO: 20780
  misc_feature 1..1731: note = derived and/or modified sequence opt2 from anti-influenza_Chain
  source 1..1731: mol_type = other RNA

SEQ ID NO: 20782 - RNA, 1737 nt, synthetic construct
  misc_feature 1..1737: note = derived and/or modified sequence opt2 from anti-influenza_Chain
  source 1..1737: mol_type = other RNA
atggtcgtcacctccaacgccgaccgcatctgcaccggcatcacctcctccaactccccccacgtcgtcaagaccgccacccagggcgaggtcaacgtcaccggcgtcatccccctcaccaccacccccaccaagtcccacttcgccaacctcaagggcacccagacccgcggcaagctctgccccaactgcctcaactgcaccgacctcgacgtcgccctcggccgccccaagtgcatgggcaccatcccctccgccaaggcctccatcctccacgaggtcaagcccgtcacctccggctgcttccccatcatgcacgaccgcaccaagatccgccagctccccaacctcctccgcggctacgagaacatccgcctctccgcccgcaacgtcatcaacgccgagaccgcccccggcggcccctacatcgtcggcacctccggctcctgccccaacgtcaccaacggcaagggcttcttcgccaccatggcctgggccgtccccaagaacaagaacaagaccgccaccaaccccctcaccgtcgaggtcccctacatctgcaccaagggcgaggaccagatcaccgtctggggcttccactccgacaacgaggcccagatggtcaccctctacggcgactccaagccccagaagttcacctcctccgccaacggcgtcaccacccactacgtctcccagatcggcggcttccccaaccagaccgaggacgagggcctccagcagtccggccgcatcgtcgtcgactacatggtccagaagcccggcaagaccggcaccatcgtctaccagcgcggcgtcctcctcccccagaaggtctggtgcgcctccggccgctccaaggtcatcaagggctccctccccctcatcggcgaggccgactgcctccacgagaagtacggcggcctcaacaagtccaagccctactacaccggcgagcacgccaaggccatcggcaactgccccatctgggtcaagacccccctcaagctcgccaacggcaccaagtaccgcccccccgccaagctcctcaaggagcgcggcttcttcggcgccatcgccggcttcctcgagggcggctgggagggcatgatcgccggctggcacggctacacctcccacggcgcccacggcgtcgccgtcgccgccgacctcaagtccacccaggaggccatcaacaagatcaccaagaacctcaactccctctccgagctcgaggtcaagaacctccagcgcctctccggcgccatggacgagctccacaacgagatcctcgagctcgacgagaaggtcgacgacctccgcgccgacaccatctcctcccagatcgagctcgccgtcctcctctccaacgagggcatcatcaactccgaggacgagcacctcctcgccctcgagcgcaagctcaagaagatgctcggcccctccgccgtcgacatcggcaacggctgcttcgagaccaagcacaagtgcaaccagacctgcctcgaccgcatcgccgccggcaccttcaacgccggcgagttctccctccccaccttcgactccctcaacatcaccgccgcctccctcaacgacgacggcctcgacaaccacaccatcctcctctactactccaccgccgcctcctccctcgccgtcaccctcatgatcgccatcttcatcgtctacatggtctcccgcgacaacgtcttcctcctccacctctccatccgcaag

SEQ ID NO: 20783 - RNA, 1737 nt, synthetic construct; identical to SEQ ID NO: 20782
  misc_feature 1..1737: note = derived and/or modified sequence opt2 from anti-influenza_Chain
  source 1..1737: mol_type = other RNA

SEQ ID NO: 20784 - RNA, 1731 nt, synthetic construct
  misc_feature 1..1731: note = derived and/or modified sequence opt2 from anti-influenza_Chain
  source 1..1731: mol_type = other RNA
atggagaccatctccctcatcaccatcctcctcgtcgtcaccgcctccaacgccgacaagatctgcatcggccaccagtccaccaactccaccgagaccgtcgacaccctcaccgagaccaacgtccccgtcacccacgccaaggagctcctccacaccgagcacaacggcatgctctgcgccacctccctcggccaccccctcatcctcgacacctgcaccatcgagggcctcgtctacggcaacccctcctgcgacctcctcctcggcggccgcgagtggtcctacatcgtcgagcgctcctccgccgtcaacggcacctgctaccccggcaacgtcgagaacctcgaggagctccgcaccctcttctcctccgcctcctcctaccagcgcatccagatcttccccgacaccacctggaacgtcacctacaccggcacctcccgcgcctgctccggctccttctaccgctccatgcgctggctcacccagaagtccggcttctaccccgtccaggacgcccagtacaccaacaaccgcggcaagtccatcctcttcgtctggggcatccaccacccccccacctacaccgagcagaccaacctctacatccgcaacgacaccaccacctccgtcaccaccgaggacctcaaccgcaccttcaagcccgtcatcggcccccgccccctcgtcaacggcctccagggccgcatcgactactactggtccgtcctcaagcccggccagaccctccgcgtccgctccaacggcaacctcatcgccccctggtacggccacgtcctctccggcggctcccacggccgcatcctcaagaccgacctcaagggcggcaactgcgtcgtccagtgccagaccgagaagggcggcctcaactccaccctccccttccacaacatctccaagtacgccttcggcacctgccccaagtacgtccgcgtcaactccctcaagctcgccgtcggcctccgcaacgtccccgcccgctcctcccgcggcctcttcggcgccatcgccggcttcatcgagggcggctggcccggcctcgtcgccggctggtacggcttccagcactccaacgaccagggcgtcggcatggccgccgaccgcgactccacccagaaggccatcgacaagatcacctccaaggtcaacaacatcgtcgacaagatgaacaagcagtacgagatcatcgaccacgagttctccgaggtcgagacccgcctcaacatgatcaacaacaagatcgacgaccagatccaggacgtctgggcctacaacgccgagctcctcgtcctcctcgagaaccagaagaccctcgacgagcacgacgccaacgtcaacaacctctacaacaaggtcaagcgcgccctcggctccaacgccatggaggacggcaagggctgcttcgagctctaccacaagtgcgacgaccagtgcatggagaccatccgcaacggcacctacaaccgccgcaagtaccgcgaggagtcccgcctcgagcgccagaagatcgagggcgtcaagctcgagtccgagggcacctacaagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20785 - RNA, 1731 nt, synthetic construct; identical to SEQ ID NO: 20784
  misc_feature 1..1731: note = derived and/or modified sequence opt2 from anti-influenza_Chain
  source 1..1731: mol_type = other RNA

SEQ ID NO: 20786 - RNA, 1752 nt, synthetic construct
  misc_feature 1..1752: note = derived and/or modified sequence opt2 from anti-influenza_Chain
  source 1..1752: mol_type = other RNA
atgaaggccatcatcgtcctcctcatggtcgtcacctccaacgccgaccgcatctgcaccggcatcacctcctccaactccccccacgtcgtcaagaccgccacccagggcgaggtcaacgtcaccggcgtcatccccctcaccaccacccccaccaagtcccacttcgccaacctcaagggcacccagacccgcggcaagctctgccccaactgcttcaactgcaccgacctcgacgtcgccctcggccgccccaagtgcatgggcaacaccccctccgccaaggtctccatcctccacgaggtcaagcccgccacctccggctgcttccccatcatgcacgaccgcaccaagatccgccagctccccaacctcctccgcggctacgagaacatccgcctctccacctccaacgtcatcaacaccgagaccgcccccggcggcccctacaaggtcggcacctccggctcctgccccaacgtcgccaacggcaacggcttcttcaacaccatggcctgggtcatccccaaggacaacaacaagaccgccatcaaccccgtcaccgtcgaggtcccctacatctgctccgagggcgaggaccagatcaccgtctggggcttccactccgacgacaagacccagatggagcgcctctacggcgactccaacccccagaagttcacctcctccgccaacggcgtcaccacccactacgtctcccagatcggcggcttccccaaccagaccgaggacgagggcctcaagcagtccggccgcatcgtcgtcgactacatggtccagaagcccggcaagaccggcaccatcgtctaccagcgcggcatcctcctcccccagaaggtctggtgcgcctccggccgctccaaggtcatcaagggctccctccccctcatcggcgaggccgactgcctccacgagaagtacggcggcctcaacaagtccaagccctactacaccggcgagcacgccaaggccatcggcaactgccccatctgggtcaagacccccctcaagctcgccaacggcaccaagtaccgcccccccgccaagctcctcaaggagcgcggcttcttcggcgccatcgccggcttcctcgagggcggctgggagggcatgatcgccggctggcacggctacacctcccacggcgcccacggcgtcgccgtcgccgccgacctcaagtccacccaggaggccatcaacaagatcaccaagaacctcaactacctctccgagctcgaggtcaagaacctccagcgcctctccggcgccatgaacgagctccacgacgagatcctcgagctcgacgagaaggtcgacgacctccgcgccgacaccatctcctcccagatcgagctcgccgtcctcctctccaacgagggcatcatcaactccgaggacgagcacctcctcgccctcgagcgcaagctcaagaagatgctcggcccctccgccgtcgagatcggcaacggctgcttcgagaccaagcacaagtgcaaccagacctgcctcgaccgcatcgccgccggcaccttcaacgccggcgacttctccctccccaccttcgactccctcaacatcaccgccgcctccctcaacgacgacggcctcgacaaccacaccatcctcctctactactccaccgccgcctcctccctcgccgtcaccctcatgatcgccatcttcatcgtctacatggtctcccgcgacaacgtctcctgctccatctgcctc

SEQ ID NO: 20787 - RNA, 1752 nt, synthetic construct
  misc_feature 1..1752: note = derived and/or modified sequence opt2 from anti-influenza_Chain
  source 1..1752: mol_type = other RNA
atgaaggccatcatcgtcctcctcatggtcgtcacctccaacgccgaccgcatctgcaccggcatcacctcctccaactccccccacgtcgtcaagaccgccacccagggcgaggtcaacgtcaccggcgtcatccccctcaccaccacccccaccaagtcctacttcgccaacctcaagggcaccaagacccgcggcaagctctgccccgactgcctcaactgcaccgacctcgacgtcgccctcggccgccccatgtgcgtcggcaccaccccctccgccaaggcctccatcctccacgaggtccgccccgtcacctccggctgcttccccatcatgcacgaccgcaccaagatccgccagctcgccaacctcctccgcggctacgagaacatccgcctctccacccagaacgtcatcgacgccgagaaggcccccggcggcccctaccgcctcggcacctccggctcctgccccaacgccacctccaagtccggcttcttcgccaccatggcctgggccgtccccaaggacaacaacaagaacgccaccaaccccctcaccgtcgaggtcccctacatctgcaccgagggcgaggaccagatcaccgtctggggcttccactccgacgacaagacccagatgaagaacctctacggcgactccaacccccagaagttcacctcctccgccaacggcgtcaccacccactacgtctcccagatcggcggcttccccgaccagaccgaggacggcggcctcccccagtccggccgcatcgtcgtcgactacatgatgcagaagcccggcaagaccggcaccatcgtctaccagcgcggcgtcctcctcccccagaaggtctggtgcgcctccggccgctccaaggtcatcaagggctccctccccctcatcggcgaggccgactgcctccacgagaagtacggcggcctcaacaagtccaagccctactacaccggcgagcacgccaaggccatcggcaactgccccatctgggtcaagacccccctcaagctcgccaacggcaccaagtaccgcccccccgccaagctcctcaaggagcgcggcttcttcggcgccatcgccggcttcctcgagggcggctgggagggcatgatcgccggctggcacggctacacctcccacggcgcccacggcgtcgccgtcgccgccgacctcaagtccacccaggaggccatcaacaagatcaccaagaacctcaactccctctccgagctcgaggtcaagaacctccagcgcctctccggcgccatggacgagctccacaacgagatcctcgagctcgacgagaaggtcgacgacctccgcgccgacaccatctcctcccagatcgagctcgccgtcctcctctccaacgagggcatcatcaactccgaggacgagcacctcctcgccctcgagcgcaagctcaagaagatgctcggcccctccgccgtcgacatcggcaacggctgcttcgagaccaagcacaagtgcaaccagacctgcctcgaccgcatcgccgccggcaccttcaacgccggcgagttctccctccccaccttcgactccctcaacatcaccgccgcctccctcaacgacgacggcctcgacaaccacaccatcctcctctactactccaccgccgcctcctccctcgccgtcaccctcatgctcgccatcttcatcgtctacatggtctcccgcgacaacgtctcctgctccatctgcctc

SEQ ID NO: 20788 - RNA, 1752 nt, synthetic construct
  misc_feature 1..1752: note = derived and/or modified sequence opt2 from anti-influenza_Chain
  source 1..1752: mol_type = other RNA
atgaaggccatcatcgtcctcctcatggtcgtcacctccaacgccgaccgcatctgcaccggcatcacctcctccaactccccccacgtcgtcaagaccgccacccagggcgaggtcaacgtcaccggcgtcatccccctcaccaccacccccaccaagtcctacttcgccaacctcaagggcacccgcacccgcggcaagctctgccccgactgcctcaactgcaccgacctcgacgtcgccctcggccgccccatgtgcgtcggcaccaccccctccgccaaggcctccatcctccacgaggtcaagcccgtcacctccggctgcttccccatcatgcacgaccgcaccaagatccgccagctccccaacctcctccgcggctacgagaacatccgcctctccacccagaacgtcatcgacgccgagaaggcccccggcggcccctaccgcctcggcacctccggctcctgccccaacgccacctccaagtccggcttcttcgccaccatggcctgggccgtccccaaggacaacaacaagaacgccaccaaccccctcaccgtcgaggtcccctacatctgcaccgagggcgaggaccagatcaccgtctggggcttccactccgacgacaagacccagatgaagaacctctacggcgactccaacccccagaagttcacctcctccgccaacggcgtcaccacccactacgtctcccagatcggctccttccccgaccagaccgaggacggcggcctcccccagtccggccgcatcgtcgtcgactacatgatgcagaagcccggcaagaccggcaccatcgtctaccagcgcggcgtcctcctcccccagaaggtctggtgcgcctccggccgctccaaggtcatcaagggctccctccccctcatcggcgaggccgactgcctccacgagaagtacggcggcctcaacaagtccaagccctactacaccggcgagcacgccaaggccatcggcaactgccccatctgggtcaagacccccctcaagctcgccaacggcaccaagtaccgcccccccgccaagctcctcaaggagcgcggcttcttcggcgccatcgccggcttcctcgagggcggctgggagggcatgatcgccggctggcacggctacacctcccacggcgcccacggcgtcgccgtcgccgccgacctcaagtccacccaggaggccatcaacaagatcaccaagaacctcaactccctctccgagctcgaggtcaagaacctccagcgcctctccggcgccatggacgagctccacaacgagatcctcgagctcgacgagaaggtcgacgacctccgcgccgacaccatctcctcccagatcgagctcgccgtcctcctctccaacgagggcatcatcaactccgaggacgagcacctcctcgccctcgagcgcaagctcaagaagatgctcggcccctccgccgtcgagatcggcaacggctgcttcgagaccaagcacaagtgcaaccagacctgcctcgaccgcatcgccgccggcaccttcaacgccggcgagttctccctccccaccttcgactccctcaacatcaccgccgcctccctcaacgacgacggcctcgacaaccacaccatcctcctctactactccaccgccgcctcctccctcgccgtcaccctcatgctcgccatcttcatcgtctacatggtctcccgcgacaacgtctcctgctccatctgcctc

SEQ ID NO: 20789 - RNA, 1752 nt, synthetic construct; identical to SEQ ID NO: 20786
  misc_feature 1..1752: note = derived and/or modified sequence opt2 from anti-influenza_Chain
  source 1..1752: mol_type = other RNA

SEQ ID NO: 20790 - RNA, 1752 nt, synthetic construct; identical to SEQ ID NO: 20787
  misc_feature 1..1752: note = derived and/or modified sequence opt2 from anti-influenza_Chain
  source 1..1752: mol_type = other RNA

SEQ ID NO: 20791 - RNA, 1752 nt, synthetic construct; identical to SEQ ID NO: 20788
  misc_feature 1..1752: note = derived and/or modified sequence opt2 from anti-influenza_Chain
  source 1..1752: mol_type = other RNA

SEQ ID NO: 20792 - RNA, 1758 nt, synthetic construct
  misc_feature 1..1758: note = derived and/or modified sequence opt2 from anti-influenza_Chain
  source 1..1758: mol_type = other RNA
atgaaggccatcatcgtcctcctcatggtcgtcacctccaacgccgaccgcatcatctgcaccggcatcacctcctccaactccccccacgtcgtcaagaccgccacccagggcgaggtcaacgtcaccggcgtcatccccctcaccaccacccccaccaagtcccacttcgccaacctcaagggcaccgagacccgcggcaagctctgccccaagtgcctcaactgcaccgacctcgacgtcgccctcggccgccccaagtgcaccggcaacatcccctccgcccgcgtctccatcctccacgaggtccgccccgtcacctccggctgcttccccatcatgcacgaccgcaccaagatccgccagctccccaacctcctccgcggctacgagcacatccgcctctccacccacaacgtcatcaacgccgagaacgcccccggcggcccctacaagatcggcacctccggctcctgccccaacgtcaccaacggcaacggcttcttcgccaccatggcctgggccgtccccaagaacgacaacaacaagaccgccaccaactccctcaccatcgaggtcccctacatctgcaccgagggcgaggaccagatcaccgtctggggcttccactccgacaacgagacccagatggccaagctctacggcgactccaagccccagaagttcacctcctccgccaacggcgtcaccacccactacgtctcccagatcggcggcttccccaaccagaccgaggacggcggcctcccccagtccggccgcatcgtcgtcgactacatggtccagaagtccggcaagaccggcaccatcacctaccagcgcggcatcctcctcccccagaaggtctggtgcgcctccggccgctccaaggtcatcaagggctccctccccctcatcggcgaggccgactgcctccacgagaagtacggcggcctcaacaagtccaagccctactacaccggcgagcacgccaaggccatcggcaactgccccatctgggtcaagacccccctcaagctcgccaacggcaccaagtaccgcccccccgccaagctcctcaaggagcgcggcttcttcggcgccatcgccggcttcctcgagggcggctgggagggcatgatcgccggctggcacggctacacctcccacggcgcccacggcgtcgccgtcgccgccgacctcaagtccacccaggaggccatcaacaagatcaccaagaacctcaactccctctccgagctcgaggtcaagaacctccagcgcctctccggcgccatggacgagctccacaacgagatcctcgagctcgacgagaaggtcgacgacctccgcgccgacaccatctcctcccagatcgagctcgccgtcctcctctccaacgagggcatcatcaactccgaggacgagcacctcctcgccctcgagcgcaagctcaagaagatgctcggcccctccgccgtcgagatcggcaacggctgcttcgagaccaagcacaagtgcaaccagacctgcctcgaccgcatcgccgccggcaccttcgacgccggcgagttctccctccccaccttcgactccctcaacatcaccgccgcctccctcaacgacgacggcctcgacaaccacaccatcctcctctactactccaccgccgcctcctccctcgccgtcaccctcatgatcgccatcttcgtcgtctacatggtctcccgcgacaacgtctcctgctccatctgcctc

SEQ ID NO: 20793 - RNA, 1758 nt, synthetic construct; identical to SEQ ID NO: 20792
  misc_feature 1..1758: note = derived and/or modified sequence opt2 from anti-influenza_Chain
  source 1..1758: mol_type = other RNA

SEQ ID NO: 20794 - RNA, 1749 nt, synthetic construct
  misc_feature 1..1749: note = derived and/or modified sequence opt2 from anti-influenza_Chain
  source 1..1749: mol_type = other RNA
atggaggcccgcctcctcgtcctcctctgcgccttcgccgccaccaacgccgacaccatctgcatcggctaccacgccaacaactccaccgacaccgtcgacaccgtcctcgagaagaacgtcaccgtcacccactccgtcaacctcctcgaggactcccacaacggcaagctctgcaagctcaagggcatcgcccccctccagctcggcaagtgcaacatcgccggctggctcctcggcaaccccgagtgcgacctcctcctcaccgcctcctcctggtcctacatcgtcgagacctccaactccgagaacggcacctgctaccccggcgacttcatcgactacgaggagctccgcgagcagctctcctccgtctcctccttcgagaagttcgagatcttccccaagacctcctcctggcccaaccacgagaccaccaagggcgtcaccgccgcctgctcctacgccggcgcctcctccttctaccgcaacctcctctggctcaccaagaagggctcctcctaccccaagctctccaagtcctacgtcaacaacaagggcaaggaggtcctcgtcctctggggcgtccaccacccccccaccggcaccgaccagcagtccctctaccagaacgccgacgcctacgtctccgtcggctcctccaagtacaaccgccgcttcacccccgagatcgccgcccgccccaaggtccgcgaccaggccggccgcatgaactactactggaccctcctcgagcccggcgacaccatcaccttcgaggccaccggcaacctcatcgccccctggtacgccttcgccctcaaccgcggctccggctccggcatcatcacctccgacgcccccgtccacgactgcaacaccaagtgccagaccccccacggcgccatcaactcctccctccccttccagaacatccaccccgtcaccatcggcgagtgccccaagtacgtccgctccaccaagctccgcatggccaccggcctccgcaacatcccctccatccagtcccgcggcctcttcggcgccatcgccggcttcatcgagggcggctggaccggcatgatcgacggctggtacggctaccaccaccagaacgagcagggctccggctacgccgccgaccagaagtccacccagaacgccatcgacggcatcaccaacaaggtcaactccgtcatcgagaagatgaacacccagttcaccgccgtcggcaaggagttcaacaacctcgagcgccgcatcgagaacctcaacaagaaggtcgacgacggcttcctcgacatctggacctacaacgccgagctcctcgtcctcctcgagaacgagcgcaccctcgacttccacgactccaacgtccgcaacctctacgagaaggtcaagtcccagctcaagaacaacgccaaggagatcggcaacggctgcttcgagttctaccacaagtgcgacgacgcctgcatggagtccgtccgcaacggcacctacgactaccccaagtactccgaggagtccaagctcaaccgcgaggagatcgacggcgtcaagctcgagtccatgggcgtctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20795 - RNA, 1749 nt, synthetic construct; identical to SEQ ID NO: 20794
  misc_feature 1..1749: note = derived and/or modified sequence opt2 from anti-influenza_Chain
  source 1..1749: mol_type = other RNA

SEQ ID NO: 20796 - RNA, 1755 nt, synthetic construct
  misc_feature 1..1755: note = derived and/or modified sequence opt2 from anti-influenza_Chain
  source 1..1755: mol_type = other RNA
atggagcgcaccgtcctcctcctcgccaccgtctccctcgtcaagtccgaccagatctgcatcggctaccacgccaacaactccaccgagcaggtcgacaccatcatggagaagaacgtcaccgtcacccacgcccaggacatcctcgagcgcacccacaacggcaagctctgcgacctcaacggcgtcaagcccctcatcctccgcgactgctccgtcgccggctggctcctcggcaaccccatgtgcgacgagttcatcaacgtccccgagtggtcctacatcgtcgagaaggcctcccccgccaacgacctctgctaccccggcaacttcaacgactacgaggagctcaagcacctcctctcccgcatcaaccacttcgagaagatccagatcatccccaagtcctcctggtccaaccacgacgcctcctccggcgtctcctccgcctgcccctacctcggccgctcctccttcttccgcaacgtcgtctggctcatcaagaagaactccgcctaccccaccatcaagcgctcctacaacaacaccaaccaggaggacctcctcgtcctctggggcgtccaccaccccaacgacgccgccgagcagaccaagctctaccagaaccccaccacctacatctccgtcggcacctccaccctcaaccagcgcctcgtccccgagatcgccacccgccccaaggtcaacggccagtccggccgcatggagttcttctggaccatcctcaagcccaacgacgccatcaacttcgagtccaacggcaacttcatcgcccccgagtacgcctacaagatcgtcaagaagggcgactccaccatcatgaagtccgagctcgagtacggcaactgcaacaccaagtgccagacccccatgggcgccatcaactcctccatgcccttccacaacatccaccccctcaccatcggcgagtgccccaagtacgtcaagtccaaccgcctcgtcctcgccaccggcctccgcaacaccccccagcgcgagcgccgccgcaagaagcgcggcctcttcggcgccatcgccggcttcatcgagggcggctggcagggcatggtcgacggctggtacggctaccaccactccaacgagcagggctcctgctactccgccgacaaggagtccacccagaaggccatcgacggcgtcaccaacaaggtcaactccatcatcaacaagatgaacacccagttcgaggccgtcggccgcgagttcaacaacctcgagcgccgcatcgagaacctcaacaagaagatggaggacggcttcctcgacgtctggacctacaacgccgagctcctcgtcctcatggagaacgagcgcaccctcgacttccacgactccaacgtcaagaacctctacgacaaggtccgcctccagctccgcgacaacgccaaggagctcggcaacggctgcttcgagttctaccacaagtgcgacaacgagtgcatggagtccgtcaagaacggcacctacgactacccccagtactccgaggaggcccgcctcaaccgcgaggagatctccggcgtcaagctcgagtccatgggcacctaccagtccggccgcctcgtcccccgcggctcccccggctccggctacatccccgaggccccccgcgacggccaggcctacgtccgcaaggacggcgagtgggtcctcctctccaccttcctcggcaagcccatccccaaccccctcctcggcctcgactccaccggc

SEQ ID NO: 20797 - RNA, 1755 nt, synthetic construct; identical to SEQ ID NO: 20796
  misc_feature 1..1755: note = derived and/or modified sequence opt2 from anti-influenza_Chain
  source 1..1755: mol_type = other RNA

SEQ ID NO: 20798 - RNA, 1947 nt, synthetic construct
  misc_feature 1..1947: note = derived and/or modified sequence opt2 from anti-influenza_Chain
  source 1..1947: mol_type = other RNA
atgggcgacaagatcaacttcatcttcggcatccacaaccaccagcccctcggcaacttcggctgggtcttcgaggaggcctacgagaagtgctactggcccttcctcgagaccctcgaggagtaccccaacatgaaggtcgccatccacacctccggccccctcatcgagtggctccaggacaaccgccccgagtacatcgacctcctccgctccctcgtcaagcgcggccaggtcgagatcgtcgtcgccggcttctacgagcccgtcctcgcctccatccccaaggaggaccgcatcgagcagatccgcctcatgaaggagtgggccaagtccatcggcttcgacgcccgcggcgtctggctcaccgagcgcgtctggcagcccgagctcgtcaagaccctcaaggagtccggcatcgactacgtcatcgtcgacgactaccacttcatgtccgccggcctctccaaggaggagctctactggccctactacaccgaggacggcggcgaggtcatcgccgtcttccccatcgacgagaagctccgctacctcatccccttccgccccgtcgacaaggtcctcgagtacctccactccctcatcgacggcgacgagtccaaggtcgccgtcttccacgacgacggcgagaagttcggcatctggcccggcacctacgagtgggtctacgagaagggctggctccgcgagttcttcgaccgcatctcctccgacgagaagatcaacctcatgctctacaccgagtacctcgagaagtacaagccccgcggcctcgtctacctccccatcgcctcctacttcgagatgtccgagtggtccctccccgccaagcaggcccgcctcttcgtcgagttcgtcaacgagctcaaggtcaagggcatcttcgagaagtaccgcgtcttcgtccgcggcggcatctggaagaacttcttctacaagtaccccgagtccaactacatgcacaagcgcatgctcatggtctccaagctcgtccgcaacaaccccgaggcccgcaagtacctcctccgcgcccagtgcaacgacgcctactggcacggcctcttcggcggcgtctacctcccccacctccgccgcgccatctggaacaacctcatcaaggccaactcctacgtctccctcggcaaggtcatccgcgacatcgactacgacggcttcgaggaggtcctcatcgagaacgacaacttctacgccgtcttcaagccctcctacggcggctccctcgtcgagttctcctccaagaaccgcctcgtcaactacgtcgacgtcctcgcccgccgctgggagcactaccacggctacgtcgagtcccagttcgacggcgtcgcctccatccacgagctcgagaagaagatccccgacgagatccgcaaggaggtcgcctacgacaagtaccgccgcttcatgctccaggaccacgtcgtccccctcggcaccaccctcgaggacttcatgttctcccgccagcaggagatcggcgagttcccccgcgtcccctactcctacgagctcctcgacggcggcatccgcctcaagcgcgagcacctcggcatcgaggtcgagaagaccgtcaagctcgtcaacgacggcttcgaggtcgagtacatcgtcaacaacaagaccggcaaccccgtcctcttcgccgtcgagctcaacgtcgccgtccagtccatcatggagtcccccggcgtcctccgcggcaaggagatcgtcgtcgacgacaagtacgccgtcggcaagttcgccctcaagttcgaggacgagatggaggtctggaagtaccccgtcaagaccctctcccagtccgagtccggctgggacctcatccagcagggcgtctcctacatcgtccccatccgcctcgaggacaagatccgcttcaagctcaagttcgaggaggcctccggc

SEQ ID NO: 20799 - RNA, 1947 nt, synthetic construct
  misc_feature 1..1947: note = derived and/or modified sequence opt2 from anti-influenza_Chain
  source 1..1947: mol_type = other RNA
atgtcccgcatgaccctcaagtcctccatgaagaagcgcgtcctctccctcctcatcgccgtcgtcttcctctccctcaccggcgtcttcccctccggcctcatcgagaccaaggtctccgccgccaagatcaccgagaactaccagttcgactcccgcatccgcctcaactccatcggcttcatccccaaccactccaagaaggccaccatcgccgccaactgctccaccttctacgtcgtcaaggaggacggcaccatcgtctacaccggcaccgccacctccatgttcgacaacgacaccaaggagaccgtctacatcgccgacttctcctccgtcaacgaggagggcacctactacctcgccgtccccggcgtcggcaagtccgtcaacttcaagatcgccatgaacgtctacgaggacgccttcaagaccgccatgctcggcatgtacctcctccgctgcggcacctccgtctccgccacctacaacggcatccactactcccacggcccctgccacaccaacgacgcctacctcgactacatcaacggccagcacaccaagaaggactccaccaagggctggcacgacgccggcgactacaacaagtacgtcgtcaacgccggcatcaccgtcggctccatgttcctcgcctgggagcacttcaaggaccagctcgagcccgtcgccctcgagatccccgagaagaacaactccatccccgacttcctcgacgagctcaagtacgagatcgactggatcctcaccatgcagtaccccgacggctccggccgcgtcgcccacaaggtctccacccgcaacttcggcggcttcatcatgcccgagaacgagcacgacgagcgcttcttcgtcccctggtcctccgccgccaccgccgacttcgtcgccatgaccgccatggccgcccgcatcttccgcccctacgacccccagtacgccgagaagtgcatcaacgccgccaaggtctcctacgagttcctcaagaacaaccccgccaacgtcttcgccaaccagtccggcttctccaccggcgagtacgccaccgtctccgacgccgacgaccgcctctgggccgccgccgagatgtgggagaccctcggcgacgaggagtacctccgcgacttcgagaaccgcgccgcccagttctccaagaagatcgaggccgacttcgactgggacaacgtcgccaacctcggcatgttcacctacctcctctccgagcgccccggcaagaaccccgccctcgtccagtccatcaaggactccctcctctccaccgccgactccatcgtccgcacctcccagaaccacggctacggccgcaccctcggcaccacctactactggggctgcaacggcaccgtcgtccgccagaccatgatcctccaggtcgccaacaagatctcccccaacaacgactacgtcaacgccgccctcgacgccatctcccacgtcttcggccgcaactactacaaccgctcctacgtcaccggcctcggcatcaacccccccatgaacccccacgaccgccgctccggcgccgacggcatctgggagccctggcccggctacctcgtcggcggcggctggcccggccccaaggactgggtcgacatccaggactcctaccagaccaacgagatcgccatcaactggaacgccgccctcatctacgccctcgccggcttcgtcaactacaactccccccagaacgaggtcctctacggcgacgtcaacgacgacggcaaggtcaactccaccgacctcaccctcctcaagcgctacgtcctcaaggccgtctccaccctcccctcctccaaggccgagaagaacgccgacgtcaaccgcgacggccgcgtcaactcctccgacgtcaccatcctctcccgctacctcatccgcgtcatcgagaagctccccatc

SEQ ID NO: 20800 - RNA, 1947 nt, synthetic construct; identical to SEQ ID NO: 20798
  misc_feature 1..1947: note = derived and/or modified sequence opt2 from anti-influenza_Chain
  source 1..1947: mol_type = other RNA

SEQ ID NO: 20801 - RNA, 1947 nt, synthetic construct; identical to SEQ ID NO: 20799
  misc_feature 1..1947: note = derived and/or modified sequence opt2 from anti-influenza_Chain
  source 1..1947: mol_type = other RNA

SEQ ID NO: 20802 - RNA, 2046 nt, synthetic construct
  misc_feature 1..2046: note = derived and/or modified sequence opt2 from anti-influenza_Chain
  source 1..2046: mol_type = other RNA
atgaagccctcccacttcaccgagaagcgcttcatgaagaaggtcctcggcctcttcctcgtcgtcgtcatgctcgcctccgtcggcgtcctccccacctccaaggtccaggccgccggcaccaccgtcacctccatggagtacttctcccccgccgacggccccgtcatctccaagtccggcgtcggcaaggcctcctacggcttcgtcatgcccaagttcaacggcggctccgccacctggaacgacgtctactccgacgtcggcgtcaacgtcaaggtcggcaacaactgggtcgacatcgaccaggccggcggctacatctacaaccagaactggggccactggtccgacggcggcttcaacggctactggttcaccctctccgccaccaccgagatccagctctactccaaggccaacggcgtcaagctcgagtaccagctcgtcttccagaacatcaacaagaccaccatcaccgccatgaaccccacccagggcccccagatcaccgcctccttcaccggcggcgccggcttcacctaccccaccttcaacaacgactccgccgtcacctacgaggccgtcgccgacgacctcaaggtctacgtcaagcccgtcaactcctcctcctggatcgacatcgacaacaacgccgcctccggctggatctacgaccacaacttcggccagttcaccgacggcggcggcggctactggttcaacgtcaccgagtccatcaacgtcaagctcgagtccaagacctcctccgccaacctcgtctacaccatcaccttcaacgagcccacccgcaactcctacgtcatcaccccctacgagggcaccaccttcaccgccgacgccaacggctccatcggcatccccctccccaagatcgacggcggcgcccccatcgccaaggagctcggcaacttcgtctaccagatcaacatcaacggccagtgggtcgacctctccaactcctcccagtccaagttcgcctactccgccaacggctacaacaacatgtccgacgccaaccagtggggctactgggccgactacatctacggcctctggttccagcccatccaggagaacatgcagatccgcatcggctaccccctcaacggccaggccggcggcaacatcggcaacaacttcgtcaactacaccttcatcggcaaccccaacgccccccgccccgacgtctccgaccaggaggacatctccatcggcacccccaccgaccccgccatcgccggcatgaacctcatctggcaggacgagttcaacggcaccaccctcgacacctccaagtggaactacgagaccggctactacctcaacaacgaccccgccacctggggctggggcaacgccgagctccagcactacaccaactccacccagaacgtctacgtccaggacggcaagctcaacatcaaggccatgaacgactccaagtccttcccccaggaccccaaccgctacgcccagtactcctccggcaagatcaacaccaaggacaagctctccctcaagtacggccgcgtcgacttccgcgccaagctccccaccggcgacggcgtctggcccgccctctggatgctccccaaggactccgtctacggcacctgggccgcctccggcgagatcgacgtcatggaggcccgcggccgcctccccggctccgtctccggcaccatccacttcggcggccagtggcccgtcaaccagtcctccggcggcgactaccacttccccgagggccagaccttcgccaacgactaccacgtctactccgtcgtctgggaggaggacaacatcaagtggtacgtcgacggcaagttcttctacaaggtcaccaaccagcagtggtactccaccgccgcccccaacaaccccaacgcccccttcgacgagcccttctacctcatcatgaacctcgccgtcggcggcaacttcgacggcggccgcacccccaacgcctccgacatccccgccaccatgcaggtcgactacgtccgcgtctacaaggagcag

SEQ ID NO: 20803 - RNA, 2046 nt, synthetic construct; identical to SEQ ID NO: 20802
  misc_feature 1..2046: note = derived and/or modified sequence opt2 from anti-influenza_Chain
  source 1..2046: mol_type = other RNA

SEQ ID NO: 20804 - RNA, 2058 nt, synthetic construct
  misc_feature 1..2058: note = derived and/or modified sequence opt2 from anti-influenza_Chain
  source 1..2058: mol_type = other RNA
atgaccaagtccatctacttctccctcggcatccacaaccaccagcccgtcggcaacttcgacttcgtcatcgagcgcgcctacgagatgtcctacaagcccctcatcaacttcttcttcaagcaccccgacttccccatcaacgtccacttctccggcttcctcctcctctggctcgagaagaaccaccccgagtacttcgagaagctcaagatcatggccgagcgcggccagatcgagttcgtctccggcggcttctacgagcccatcctccccatcatccccgacaaggacaaggtccagcagatcaagaagctcaacaagtacatctacgacaagttcggccagacccccaagggcatgtggctcgccgagcgcgtctgggagccccacctcgtcaagtacatcgccgaggccggcatcgagtacgtcgtcgtcgacgacgcccacttcttctccgtcggcctcaaggaggaggacctcttcggctactacctcatggaggagcagggctacaagctcgccgtcttccccatctccatgaagctccgctacctcatccccttcgccgaccccgaggagaccatcacctacctcgacaagttcgcctccgaggacaagtccaagatcgccctcctcttcgacgacggcgagaagttcggcctctggcccgacacctaccgcaccgtctacgaggagggctggctcgagaccttcgtctccaagatcaaggagaacttcctcctcgtcacccccgtcaacctctacacctacatgcagcgcgtcaagcccaagggccgcatctacctccccaccgcctcctaccgcgagatgatggagtgggtcctcttccccgaggcccagaaggagctcgaggagctcgtcgagaagctcaagaccgagaacctctgggacaagttctccccctacgtcaagggcggcttctggcgcaacttcctcgccaagtacgacgagtccaaccacatgcagaagaagatgctctacgtctggaagaaggtccaggactcccccaacgaggaggtcaaggagaaggccatggaggaggtcttccagggccaggccaacgacgcctactggcacggcatcttcggcggcctctacctcccccacctccgcaccgccatctacgagcacctcatcaaggccgagaactacctcgagaactccgagatccgcttcaacatcttcgacttcgactgcgacggcaacgacgagatcatcgtcgagtcccccttcttcaacctctacctctcccccaaccacggcggctccgtcctcgagtgggacttcaagaccaaggccttcaacctcaccaacgtcctcacccgccgcaaggaggcctaccactccaagctctcctacgtcacctccgaggcccagggcaagtccatccacgagcgctggaccgccaaggaggagggcctcgagaacatcctcttctacgacaaccaccgccgcgtctccttcaccgagaagatcttcgagtccgagcccgtcctcgaggacctctggaaggactcctcccgcctcgaggtcgactccttctacgagaactacgactacgagatcaacaaggacgagaacaagatccgcgtcctcttctccggcgtcttccgcggcttcgagctctgcaagtcctacatcctctacaaggacaagtccttcgtcgacgtcgtctacgagatcaagaacgtctccgagacccccatctccctcaacttcggctgggagatcaacctcaacttcctcgcccccaaccaccccgactactacttcctcatcggcgaccagaagtaccccctctcctccttcggcatcgagaaggtcaacaactggaagatcttctccggcatcggcatcgagctcgagtgcgtcctcgacgtcgaggcctccctctaccgctaccccatcgagaccgtctccctctccgaggagggcttcgagcgcgtctaccagggctccgccctcatccacttctacaaggtcgacctccccgtcggctccacctggcgcaccaccatccgcttctgggtcaag

SEQ ID NO: 20805 - RNA, 2058 nt, synthetic construct; identical to SEQ ID NO: 20804
  misc_feature 1..2058: note = derived and/or modified sequence opt2 from anti-influenza_Chain
  source 1..2058: mol_type = other RNA

SEQ ID NO: 20806 - RNA, 2115 nt, synthetic construct
  misc_feature 1..2115: note = derived and/or modified sequence opt2 from anti-influenza_Chain
  source 1..2115: mol_type = other RNA
atgcccaccaacctcttcttcaacgcccaccactcccccgtcggcgccttcgcctccttcaccctcggcttccccggcaagtccggcggcctcgacctcgagctcgcccgccccccccgccagaacgtcctcatcggcgtcgagtccctccacgagtccggcctctaccacgtcctccccttcctcgagaccgccgaggaggacgagtccaagcgctacgacatcgagaaccccgaccccaacccccagaagcccaacatcctcatccccttcgccaaggaggagatccagcgcgagttccacgtcgccaccgacacctggaaggccggcgacctcaccttcaccatctactcccccgtcaaggccgtccccaaccccgagaccgccgacgaggaggagctcaagctcgccctcgtccccgccgtcatcgtcgagatgaccatcgacaacaccaacggcacccgcgcccgccgcgccttcttcggcttcgagggcaccgacccctacacctccatgcgccgcatcgacgacacctgcccccagctccgcggcgtcggccagggccgcatcctctccatcgtctccaaggacgagggcgtccgctccgccctccacttctccatggaggacatcctcaccgcccagctcgaggagaactggaccttcggcctcggcaaggtcggcgccctcatcgtcgacgtccccgccggcgagaagaagacctaccagttcgccgtctgcttctaccgcggcggctacgtcaccgccggcatggacgcctcctacttctacacccgcttcttccagaacatcgaggaggtcggcctctacgccctcgagcaggccgaggtcctcaaggagcagtccttccgctccaacaagctcatcgagaaggagtggctctccgacgaccagaccttcatgatggcccacgccatccgctcctactacggcaacacccagctcctcgagcacgagggcaagcccatctgggtcgtcaacgagggcgagtaccgcatgatgaacaccttcgacctcaccgtcgaccagctcttcttcgagctcaagctcaacccctggaccgtcaagaacgtcctcgacctctacgtcgagcgctactcctacgaggaccgcgtccgcttccccggcgaggagaccgagtacccctccggcatctccttcacccacgacatgggcgtcgccaacaccttctcccgcccccactactcctcctacgagctctacggcatctccggctgcttctcccacatgacccacgagcagctcgtcaactgggtcctctgcgccgccgtctacatcgagcagaccaaggactgggcctggcgcgacaagcgcctcgccatcctcgagcagtgcctcgagtccatggtccgccgcgaccaccccgaccccgagcagcgcaacggcgtcatgggcctcgactccacccgcaccatgggcggcgccgagatcaccacctacgactccctcgacgtctccctcggccaggcccgcaacaacctctacctcgccggcaagtgctgggccgcctacgtcgccctcgagaagctcttccgcgacgtcggcaaggaggagctcgccgccctcgccggcgagcaggccgagaagtgcgccgccaccatcgtctcccacgtcaccgacgacggctacatccccgccatcatgggcgagggcaacgactccaagatcatccccgccatcgagggcctcgtcttcccctacttcaccaactgccacgaggccctcgacgagaacggccgcttcggcgcctacatccaggccctccgcaaccacctccagtacgtcctccgcgagggcatctgcctcttccccgacggcggctggaagatctcctccacctccaacaactcctggctctccaagatctacctctgccagttcatcgcccgccacatcctcggctgggagtgggacgagcagggcaagcgcgccgacgccgcccacgtcgcctggctcacccaccccaccctctccatctggtcctggtccgaccagatcatcgccggcgagatcaccggctccaagtactacccccgcggcgtcacctccatcctctggctcgaggagggcgag

SEQ ID NO: 20807 - RNA, 2115 nt, synthetic construct; identical to SEQ ID NO: 20806
  misc_feature 1..2115: note = derived and/or modified sequence opt2 from anti-influenza_Chain
  source 1..2115: mol_type = other RNA

SEQ ID NO: 20808 - RNA, 2148 nt, synthetic construct
  misc_feature 1..2148: note = derived and/or modified sequence opt2 from anti-influenza_Chain
  source 1..2148: mol_type = other RNA
atggaggacttcgtccgccagtgcttcaaccccatgatcgtcgagctcgccgagaaggccatgaaggagtacggcgaggacctcaagatcgagaccaacaagttcgccgccatctgcacccacctcgaggtctgcttcatgtactccgacttccacttcatcaacgagcagggcgagtccatcatcgtcgagcccgaggaccccaacgccctcctcaagcaccgcttcgagatcatcgagggccgcgaccgcaccatggcctggaccgtcgtcaactccatctgcaacaccaccggcgccgagaagcccaagttcctccccgacctctacgactacaaggagaaccgcttcatcgagatcggcgtcacccgccgcgaggtccacatctactacctcgagaaggccaacaagatcaagtccgagaagacccacatccacatcttctccttcaccggcgaggagatggccaccaaggccgactacaccctcgacgaggagtcccgcgcccgcatcaagacccgcctcttcaccatccgccaggagatggcctcccgcggcctctgggactccttccgccagtccgagcgcggcgaggagaccatcgaggagcgcttcgagatcaccggcaccatgcgccgcctcgccgaccagtccctcccccccaacttctcctgcctcgagaacttccgcgcctacgtcgacggcttcgagcccaacggctacatcgagggcaagctctcccagatgtccaaggaggtcaacgcccgcatcgagcccttcctccgcaccaccccccgccccatccgcctccccgacggccccccctgcttccagcgctccaagttcctcctcatggactccctcaagctctccatcgaggacccctcccacgagggcgagggcatccccctctacgacgccatcaagtgcatgcgcaccttcttcggctggaaggagccctccgtcgtcaagccccacggcaagggcatcaaccccaactacctcctctcctggaagcaggtcctcgccgagctccaggacatcgagtccgaggagaagatcccccgcaccaagaacatgaagaagacctcccagctcaagtgggccctcggcgagaacatggcccccgagaaggtcgacttcgacgactgcaaggacatctccgacctcaagcagtacgactccgacgagcccgagctccgctccctctcctcctggatccagaacgagttcaacaaggcctgcgagctcaccgactccatctggatcgagctcgacgagatcggcgaggacgtcgcccccatcgagcacatcgcctccatgcgccgcaactacttcaccgccgaggtctcccactgccgcgccaccgagtacatcatgaagggcgtctacatcaacaccgccctcctcaacgcctcctgcgccgccatggacgacttccagctcatccccatgatctccaagtgccgcaccaaggagggccgccgcaagaccaacctctacggcttcatcatcaagggccgctcccacctccgcaacgacaccgacgtcgtcaacttcgtctccatggagttctccctcaccgacccccgcctcgagccccacaagtgggagaagtactgcgtcctcgagatcggcgacatgctcctccgctccgccatcggccaggtctcccgccccatgttcctctacgtccgcaccaacggcacctccaagatcaagatgaagtggggcatggagatgcgccgctgcctcctccagtccctccagcagatcgagtccatgatcgaggccgagtcctccgtcaaggagaaggacatgaccaaggagttcttcgagaaccgctccgagacctggcccatcggcgagtcccccaagggcgtcgaggagggctccatcggcaaggtctgccgcaccctcctcgccaagtccgtcttcaactccctctacgcctccccccagctcgagggcttctccgccgagtcccgcaagctcctcctcatcgtccaggccctccgcgacaacctcgagcccggcaccttcgacctcggcggcctctacgaggccatcgaggagtgcctcatcaacgacccctgggtcctcctcaacgcctcctggttcaactccttcctcacccacgccctccgc

SEQ ID NO: 20809 - RNA, 2148 nt, synthetic construct; identical to SEQ ID NO: 20808
  misc_feature 1..2148: note = derived and/or modified sequence opt2 from anti-influenza_Chain
  source 1..2148: mol_type = other RNA

SEQ ID NO: 20810 - RNA, 2256 nt, synthetic construct
  misc_feature 1..2256: note = derived and/or modified sequence opt2 from anti-influenza_Chain
  source 1..2256: mol_type = other RNA
atgaacatcaacccctacttcctcttcatcgacgtccccatccaggccgccatctccaccaccttcccctacaccggcgtccccccctactcccacggcaccggcaccggctacaccatcgacaccgtcatccgcacccacgagtactccaacaagggcaagcagtacatctccgacgtcaccggctgcgtcatggtcgaccccaccaacggccccctccccgaggacaacgagccctccgcctacgcccagctcgactgcgtcctcgaggccctcgaccgcatggacgaggagcaccccggcctcttccaggccggctcccagaacgccatggaggccctcatggtcaccaccgtcgacaagctcacccagggccgccagaccttcgactggaccgtctgccgcaaccagcccgccgccaccgccctcaacaccaccatcacctccttccgcctcaacgacctcaacggcgccgacaagggcggcctcgtccccttctgccaggacatcatcgactccctcgacaagcccgagatgatcttcttcaccgtcaagaacatcaagaagaagctccccgccaagaaccgcaagggcttcctcatcaagcgcatccccatgaaggtcaaggaccgcatcacccgcgtcgagtacatcaagcgcgccctctccctcaacaccatgaccaaggacgccgagcgcggcaagctcaagcgccgcgccatcgccaccgccggcatccagatccgcggcttcgtcctcgtcgtcgagaacctcgccaagaacatctgcgagaacctcgagcagtccggcctccccgtcggcggcaacgagaagaaggccaagctctccaacgccgtcgccaagatgctctccaactgcccccccggcggcatctccatgaccgtcaccggcgacaacaccaagtggaacgagtgcctcaacccccgcatcttcctcgccatgaccgagcgcatcacccgcgactcccccatctggttccgcgacttctgctccatcgcccccgtcctcttctccaacaagatcgcccgcctcggcaagggcttcatgatcacctccaagaccaagcgcctcaaggcccagatcccctgccccgacctcttcaacatccccctcgagcgctacaacgaggagacccgcgccaagctcaagaagctcaagcccttcttcaacgaggagggcaccgcctccctctcccccggcatgatgatgggcatgttcaacatgctctccaccgtcctcggcgtcgccgccctcggcatcaagaacatcggcaacaaggagtacctctgggacggcctccagtcctccgacgacttcgccctcttcgtcaacgccaaggacgaggagacctgcatggagggcatcaacgacttctaccgcacctgcaagctcctcggcatcaacatgtccaagaagaagtcctactgcaacgagaccggcatgttcgagttcacctccatgttctaccgcgacggcttcgtctccaacttcgccatggagctcccctccttcggcgtcgccggcgtcaacgagtccgccgacatggccatcggcatgaccatcatcaagaacaacatgatcaacaacggcatgggccccgccaccgcccagaccgccatccagctcttcatcgccgactaccgctacacctacaagtgccaccgcggcgactccaaggtcgagggcaagcgcatgaagatcatcaaggagctctgggagaacaccaagggccgcgacggcctcctcgtcgccgacggcggccccaacctctacaacctccgcaacctccacatccccgagatcatcctcaagtacaacatcatggaccccgagtacaagggccgcctcctccacccccagaaccccttcgtcggccacctctccatcgagggcatcaaggaggccgacatcacccccgcccacggccccatcaagaagatggactacgacgccgtctccggcacccactcctggcgcaccaagcgcaaccgctccatcctcaacaccgaccagcgcaacatgatcctcgaggagcagtgctacgccaagtgctgcaacctcttcgaggcctgcttcaactccgcctcctaccgcaagcccgtcggccagcactccatgctcgaggccatggcccaccgcctccgcatggacgcccgcctcgactacgagtccggccgcatgtccaaggaggacttcgagaaggccatggcccacctcggcgagatcggctacatg

SEQ ID NO: 20811 - RNA, 2256 nt, synthetic construct; identical to SEQ ID NO: 20810
  misc_feature 1..2256: note = derived and/or modified sequence opt2 from anti-influenza_Chain
  source 1..2256: mol_type = other RNA

SEQ ID NO: 20812 - RNA, 2265 nt, synthetic construct
  misc_feature 1..2265: note = derived and/or modified sequence opt2 from anti-influenza_Chain
  source 1..2265: mol_type = other RNA
atggccgtcgacatcaagaagatcatcaagcagatgaccctcgaggagaaggccggcctctgctccggcctcgacttctggcacaccaagcccgtcgagcgcctcggcatcccctccatcatgatgaccgacggcccccacggcctccgcaagcagcgcgaggacgccgagatcgccgacatcaacaactccgtccccgccacctgcttcccctccgccgccggcctcgcctgctcctgggaccgcgagctcgtcgagcgcgtcggcgccgccctcggcgaggagtgccaggccgagaacgtctccatcctcctcggccccggcgccaacatcaagcgctcccccctctgcggccgcaacttcgagtacttctccgaggacccctacctctcctccgagctcgccgcctcccacatcaagggcgtccagtcccagggcgtcggcgcctgcctcaagcacttcgccgccaacaaccaggagcaccgccgcatgaccgtcgacaccatcgtcgacgagcgcaccctccgcgagatctacttcgcctccttcgagaacgccgtcaagaaggcccgcccctgggtcgtcatgtgcgcctacaacaagctcaacggcgagtactgctccgagaaccgctacctcctcaccgaggtcctcaagaacgagtggatgcacgacggcttcgtcgtctccgactggggcgccgtcaacgaccgcgtctccggcctcgacgccggcctcgacctcgagatgcccacctcccacggcatcaccgacaagaagatcgtcgaggccgtcaagtccggcaagctctccgagaacatcctcaaccgcgccgtcgagcgcatcctcaaggtcatcttcatggccctcgagaacaagaaggagaacgcccagtacgacaaggacgcccaccaccgcctcgcccgccaggccgccgccgagtccatggtcctcctcaagaacgaggacgacgtcctccccctcaagaagtccggcaccatcgccctcatcggcgccttcgtcaagaagccccgctaccagggctccggctcctcccacatcacccccacccgcctcgacgacatctacgaggagatcaagaaggccggcggcgacaaggtcaacctcgtctactccgagggctaccgcctcgagaacgacggcatcgacgaggagctcatcaacgaggccaagaaggccgcctcctcctccgacgtcgccgtcgtcttcgccggcctccccgacgagtacgagtccgagggcttcgaccgcacccacatgtccatccccgagaaccagaaccgcctcatcgaggccgtcgccgaggtccagtccaacatcgtcgtcgtcctcctcaacggctcccccgtcgagatgccctggatcgacaaggtcaagtccgtcctcgaggcctacctcggcggccaggccctcggcggcgccctcgccgacgtcctcttcggcgaggtcaacccctccggcaagctcgccgagaccttccccgtcaagctctcccacaacccctcctacctcaacttccccggcgaggacgaccgcgtcgagtacaaggagggcctcttcgtcggctaccgctactacgacaccaagggcatcgagcccctcttccccttcggccacggcctctcctacaccaagttcgagtactccgacatctccgtcgacaagaaggacgtctccgacaactccatcatcaacgtctccgtcaaggtcaagaacgtcggcaagatggccggcaaggagatcgtccagctctacgtcaaggacgtcaagtcctccgtccgccgccccgagaaggagctcaagggcttcgagaaggtcttcctcaaccccggcgaggagaagaccgtcaccttcaccctcgacaagcgcgccttcgcctactacaacacccagatcaaggactggcacgtcgagtccggcgagttcctcatcctcatcggccgctcctcccgcgacatcgtcctcaaggagtccgtccgcgtcaactccaccgtcaagatccgcaagcgcttcaccgtcaactccgccgtcgaggacgtcatgtccgactcctccgccgccgccgtcctcggccccgtcctcaaggagatcaccgacgccctccagatcgacatggacaacgcccacgacatgatggccgccaacatcaagaacatgcccctccgctccctcgtcggctactcccagggccgcctctccgaggagatgctcgaggagctcgtcgacaagatcaacaacgtcgag

SEQ ID NO: 20813 - RNA, 2265 nt, synthetic construct; identical to SEQ ID NO: 20812
  misc_feature 1..2265: note = derived and/or modified sequence opt2 from anti-influenza_Chain
  source 1..2265: mol_type = other RNA

SEQ ID NO: 20814 - RNA, 2277 nt, synthetic construct
  misc_feature 1..2277: note = derived and/or modified sequence opt2 from anti-influenza_Chain
  source 1..2277: mol_type = other RNA
atggagcgcatcaaggagctccgcaacctcatgtcccagtcccgcacccgcgagatcctcaccaagaccaccgtcgaccacatggccatcatcaagaagtacacctccggccgccaggagaagaaccccgccctccgcatgaagtggatgatggccatgaagtaccccatcaccgccgacaagcgcatcaccgagatgatccccgagcgcaacgagcagggccagaccctctggtccaagatgaacgacgccggctccgaccgcgtcatggtctcccccctcgccgtcacctggtggaaccgcaacggccccatgaccaacaccgtccactaccccaagatctacaagacctacttcgagcgcgtcgagcgcctcaagcacggcaccttcggccccgtccacttccgcaaccaggtcaagatccgccgccgcgtcgacatcaaccccggccacgccgacctctccgccaaggaggcccaggacgtcatcatggaggtcgtcttccccaacgaggtcggcgcccgcatcctcacctccgagtcccagctcaccatcaccaaggagaagaaggaggagctccaggactgcaagatctcccccctcatggtcgcctacatgctcgagcgcgagctcgtccgcaagacccgcttcctccccgtcgccggcggcacctcctccgtctacatcgaggtcctccacctcacccagggcacctgctgggagcagatgtacacccccggcggcgaggtcaagaacgacgacgtcgaccagtccctcatcatcgccgcccgcaacatcgtccgccgcgccgccgtctccgccgaccccctcgcctccctcctcgagatgtgccactccacccagatcggcggcatccgcatggtcgacatcctcaagcagaaccccaccgaggagcaggccgtcggcatctgcaaggccgccatgggcctccgcatctcctcctccttctccttcggcggcttcaccttcaagcgcacctccggctcctccgtcaagcgcgaggaggaggtcctcaccggcaacctccagaccctcaagatccgcgtccacgagggctacgaggagttcaccatggtcggccgccgcgccaccgccatcctccgcaaggccacccgccgcctcatccagctcatcgtctccggccgcgacgagcagtccatcgccgaggccatcatcgtcgccatggtcttctcccaggaggactgcatgatcaaggccgtccgcggcgacctcaacttcgtcaaccgcgccaaccagcgcctcaaccccatgcaccagctcctccgccacttccagaaggacgccaaggtcctcttccagaactggggcgtcgagcccatcgacaacgtcatgggcatgatcggcatcctccccgacatgaccccctccatcgagatgtccatgcgcggcgtccgcatctccaagatgggcgtcgacgagtactcctccaccgagcgcgtcgtcgtctccatcgaccgcttcctccgcgtccgcgaccagcgcggcaacgtcctcctctcccccgaggaggtctccgagacccagggcaccgagaagctcaccatcacctactcctcctccatgatgtgggagatcaacggccccgagtccgtcctcgtcaacacctaccagtggatcatccgcaactgggagaccgtcaagatccagtggtcccagaaccccaccatgctctacaacaagatggagttcgagcccttccagtccctcgtccccaaggccatccgcggccagtactccggcttcgtccgcaccctcttccagcagatgcgcgacgtcctcggcaccttcgacaccgcccagatcatcaagctcctccccttcgccgccgccccccccaagcagtcccgcatgcagttctcctccttcaccgtcaacgtccgcggctccggcatgcgcatcctcgtccgcggcaactcccccgtcttcaactacaacaaggccaccaagcgcctcaccgtcctcggcaaggacgccggcaccctcaccgaggaccccgacgagggcaccgccggcgtcgagtccgccgtcctccgcggcttcctcatcctcggcaaggaggaccgccgctacggccccgccctctccatcaacgagctctccaacctcgccaagggcgagaaggccaacgtcctcatcggccagggcgacgtcgtcctcgtcatgaagcgcaagcgcgactcctccatcctcaccgactcccagaccgccaccaagcgcatccgcatggccatcaac

SEQ ID NO: 20815 - RNA, 2277 nt, synthetic construct; identical to SEQ ID NO: 20814
  misc_feature 1..2277: note = derived and/or modified sequence opt2 from anti-influenza_Chain
  source 1..2277: mol_type = other RNA

SEQ ID NO: 20816 - RNA, 2472 nt, synthetic construct
  misc_feature 1..2472: note = derived and/or modified sequence opt2 from anti-influenza_Chain
  source 1..2472: mol_type = other RNA
atgatgctccgcaagaagaccaagcagctcatctcctccatcctcatcctcgtcctcctcctctccctcttccccgccgccctcgccgccgagggcaacacccgcgaggacaacttcaagcacctcctcggcaacgacaacgtcaagcgcccctccgaggccggcgccctccagctccaggaggtcgacggccagatgaccctcgtcgaccagcacggcgagaagatccagctccgcggcatgtccacccacggcctccagtggttccccgagatcctcaacgacaacgcctacaaggccctctccaacgactgggactccaacatgatccgcctcgccatgtacgtcggcgagaacggctacgccaccaaccccgagctcatcaagcagcgcgtcatcgacggcatcgagctcgccatcgagaacgacatgtacgtcatcgtcgactggcacgtccacgcccccggcgacccccgcgaccccgtctacgccggcgccaaggacttcttccgcgagatcgccgccctctaccccaacaacccccacatcatctacgagctcgccaacgagccctcctccaacaacaacggcggcgccggcatccccaacaacgaggagggctggaaggccgtcaaggagtacgccgaccccatcgtcgagatgctccgcaagtccggcaacgccgacgacaacatcatcatcgtcggctcccccaactggtcccagcgccccgacctcgccgccgacaaccccatcgacgaccaccacaccatgtacaccgtccacttctacaccggctcccacgccgcctccaccgagtcctacccctccgagacccccaactccgagcgcggcaacgtcatgtccaacacccgctacgccctcgagaacggcgtcgccgtcttcgccaccgagtggggcacctcccaggcctccggcgacggcggcccctacttcgacgaggccgacgtctggatcgagttcctcaacgagaacaacatctcctgggccaactggtccctcaccaacaagaacgaggtctccggcgccttcacccccttcgagctcggcaagtccaacgccaccaacctcgaccccggccccgaccacgtctgggcccccgaggagctctccctctccggcgagtacgtccgcgcccgcatcaagggcgtcaactacgagcccatcgaccgcaccaagtacaccaaggtcctctgggacttcaacgacggcaccaagcagggcttcggcgtcaactccgactcccccaacaaggagctcatcgccgtcgacaacgagaacaacaccctcaaggtctccggcctcgacgtctccaacgacgtctccgacggcaacttctgggccaacgcccgcctctccgccaacggctggggcaagtccgtcgacatcctcggcgccgagaagctcaccatggacgtcatcgtcgacgagcccaccaccgtcgccatcgccgccatcccccagtcctccaagtccggctgggccaaccccgagcgcgccgtccgcgtcaacgccgaggacttcgtccagcagaccgacggcaagtacaaggccggcctcaccatcaccggcgaggacgcccccaacctcaagaacatcgccttccacgaggaggacaacaacatgaacaacatcatcctcttcgtcggcaccgacgccgccgacgtcatctacctcgacaacatcaaggtcatcggcaccgaggtcgagatccccgtcgtccacgaccccaagggcgaggccgtcctcccctccgtcttcgaggacggcacccgccagggctgggactgggccggcgagtccggcgtcaagaccgccctcaccatcgaggaggccaacggctccaacgccctctcctgggagttcggctaccccgaggtcaagccctccgacaactgggccaccgccccccgcctcgacttctggaagtccgacctcgtccgcggcgagaacgactacgtcgccttcgacttctacctcgaccccgtccgcgccaccgagggcgccatgaacatcaacctcgtcttccagccccccaccaacggctactgggtccaggcccccaagacctacaccatcaacttcgacgagctcgaggaggccaaccaggtcaacggcctctaccactacgaggtcaagatcaacgtccgcgacatcaccaacatccaggacgacaccctcctccgcaacatgatgatcatcttcgccgacgtcgagtccgacttcgccggccgcgtcttcgtcgacaacgtccgcttcgagggcgccgccaccaccgagcccgtcgagcccgagcccgtcgaccccggcgaggagaccccccccgtcgacgagaaggaggccaagaaggagcagaaggaggccgagaaggaggagaaggaggccgtcaaggaggagaagaaggaggccaaggaggagaagaaggccgtcaagaacgaggccaagaagaag

SEQ ID NO: 20817 - RNA, 2472 nt, synthetic construct; identical to SEQ ID NO: 20816
  misc_feature 1..2472: note = derived and/or modified sequence opt2 from anti-influenza_Chain
  source 1..2472: mol_type = other RNA

SEQ ID NO: 20818 - RNA, 3063 nt, synthetic construct
  misc_feature 1..3063: note = derived and/or modified sequence opt2 from anti-influenza_Chain
  source 1..3063: mol_type = other RNA
atggccggcccccaccgctcccgcgccgccggccccccccccttcgccgtcgacgagcacgtcgccctcgagatggtcgccttccgcggcgaggtcttcgccggccacggcctcctcgccgaccagcgcctcatcgcccacaccggccgccccgccctcaacgcccagcgcatcacccagcagaagcagcgcgaccagtgccgcggccagcgccaccgccaccaccagggcggccgcaacctccgcaaggcccaccgcaccttccacgagcaccagtccacccaggaccaggcccacgacgccccccacggccagcaggccaagaccggccacgagggcctcggccacgagcacgcccaggcccagcaccagcagggccagtccaacgtcgtcgaccgccaggacggcgagcccgtcgaggcccagcaccagaaggacggcgcccagcgcgccggcaacgcccccgccggccgcgtcgagctcgagcagcagcccgtcgaggcccagcaccagcagcaggagggcgacgtccgcatcggcaagcgccgccagaacgccttcgccccccccgccctcgaccacgtccacggcggccccggccgcctccagcgccacggcctcgccgtcgagcgccacgtccccgccgtccagcagcaccagcagcgcgtccagcgcggccgccagcagatcgaccacgtcctcggccacggcctccccggccgccagcgcctcgccttccgcgacggcccccgccgccccgtcggcgtcgcctcccccgtcctcggccagcgcccctgccccggccaccgcatcgtccagaacctcttccgccacggcatcgacccctgccgcgtcggccgctgccgccgctccccctccgagctccacggcatgggctgcgccgacgtccgcgcccgcggccacggccgccacatgcgcggccagcgcgacgagcaccccggccgcggccgcccctgcgcccgccgccgccacgtcgacgacgaccgcgaccgcaccccccaggagaagctctacgacgtcgcccgcggcctcgacgagcccgcccgccgcgtccacttcgacgacgaggccgaccgctccgtcttccgcggcctcgcccagcccgcccccgacgagcccgagggccgccgccgcgaccgcctcgtcctccagcgccagtccgtcaaccaccgccgcggccgcctctcccgccaccgccagcagcaccagccccagcagcagcgcccccacggcaaccaggccttcctcggcaagtacgagaagcgccgccgcaagcccaccgcctgcctcaagtccctccgccgcttccccgacaaggacgcccccgtcctctacttcgtcaaccagctcgagaagaccaagcgccgcatgaccctcctcctcgtctggctcatcttcaccggcgtcgccggcgagatccgcctcgaggccgaggacggcgagctcctcggcgtcgccgtcgactccaccctcaccggctactccggccgcggctacgtcaccggcttcgacgcccccgaggactccgtccgcttctccttcgaggccccccgcggcgtctaccgcgtcgtcttcggcgtctccttctcctcccgcttcgcctcctacgccctccgcgtcgacgactggcaccagaccggctccctcatcaagcgcggcggcggcttcttcgaggcctccatcggcgagatctggctcgacgagggcgcccacaccatggccttccagctcatgaacggcgccctcgactacgtccgcctcgagcccgtctcctacggcccccccgcccgcccccccgcccagctctccgactcccaggccaccgcctccgcccaggccctcttcgccttcctcctctccgagtacggccgccacatcctcgccggccagcagcagaacccctaccgccgcgacttcgacgccatcaactacgtccgcaacgtcaccggcaaggagcccgccctcgtctccttcgacctcatcgactactcccccacccgcgaggcccacggcgtcgtccactaccagacccccgaggactggatcgcctgggccggccgcgacggcatcgtctccctcatgtggcactggaacgcccccaccgacctcatcgaggacccctcccaggactgctactggtggtacggcttctacacccgctgcaccaccttcgacgtcgccgccgccctcgccgacacctcctccgagcgctaccgcctcctcctccgcgacatcgacgtcatcgccgcccagctccagaagttccagcaggccgacatccccgtcctctggcgccccctccacgaggccgccggcggctggttctggtggggcgccaagggccccgagcccttcaagcagctctggcgcctcctctacgagcgcctcgtccaccaccacggcctccacaacctcatctgggtctacacccacgagcccggcgccgccgagtggtaccccggcgacgcctacgtcgacatcgtcggccgcgacgtctacgccgacgaccccgacgccctcatgcgctccgactggaacgagctccagaccctcttcggcggccgcaagctcgtcgccctcaccgagaccggcaccctccccgacgtcgaggtcatcaccgactacggcatctggtggtcctggttctccatctggaccgaccccttcctccgcgacgtcgaccccgaccgcctcacccgcgtctaccactccgagcgcgtcctcacccgcgacgagctccccgactggcgctcctacgtcctccacgccaccaccgtccagcccgccggcgacctcgccctcgccgtctaccccaaccccggcgccggccgcctccacgtcgaggtcggcctccccgtcgccgcccccgtcgtcgtcgaggtcttcaacctcctcggccagcgcgtcttccagtaccaggccggcatgcagcccgccggcctctggcgccgcgccttcgagctcgccctcgcccccggcgtctacctcgtccaggtccgcgccggcaacctcgtcgcccgccgccgctgggtctccgtccgc

SEQ ID NO: 20819 - RNA, 3063 nt, synthetic construct; identical to SEQ ID NO: 20818
  misc_feature 1..3063: note = derived and/or modified sequence opt2 from anti-influenza_Chain
  source 1..3063: mol_type = other RNA

SEQ ID NO: 20820 - RNA, 3165 nt, synthetic construct
  misc_feature 1..3165: note = derived and/or modified sequence opt2 from anti-influenza_Chain
  source 1..3165: mol_type = other RNA
atgcgcaagaagcgccgcggcttcctcaacgcctccaccgccgtcctcgtcggcatcctcgccggcttcctcggcgtcgtcctcgccgccaccggcgccctcggcttcgccgtccgcgagtccctcctcctcaagcagttcctcttcctctccttcgagggcaacaccgacggcgcctcccccttcggcaaggacgtcgtcgtcaccgcctcccaggacgtcgccgccgacggcgagtactccctcaaggtcgagaaccgcacctccgtctgggacggcgtcgagatcgacctcaccggcaaggtcaacaccggcaccgactacctcctctccttccacgtctaccagacctccgactccccccagctcttctccgtcctcgcccgcaccgaggacgagaagggcgagcgctacaagatcctcgccgacaaggtcgtcgtccccaactactggaaggagatcctcgtccccttctcccccaccttcgagggcacccccgccaagttctccctcatcatcacctcccccaagaagaccgacttcgtcttctacgtcgacaacgtccaggtcctcacccccaaggaggccggccccaaggtcgtctacgagacctccttcgagaagggcatcggcgactggcagccccgcggctccgacgtcaagatctccatctcccccaaggtcgcccactccggcaagaagtccctcttcgtctccaaccgccagaagggctggcacggcgcccagatctccctcaagggcatcctcaagaccggcaagacctacgccttcgaggcctgggtctaccaggagtccggccaggaccagaccatcatcatgaccatgcagcgcaagtactcctccgactcctccaccaagtacgagtggatcaaggccgccaccgtcccctccggccagtgggtccagctctccggcacctacaccatccccgccggcgtcaccgtcgaggacctcaccctctacttcgagtcccagaaccccaccctcgagttctacgtcgacgacgtcaaggtcgtcgacaccacctccgccgagatcaagctcgagatgaaccccgaggaggagatccccgccctcaaggacgtcctcaaggactacttccgcgtcggcgtcgccctcccctccaaggtcttcatcaaccagaaggacatcgccctcatctccaagcactccaactcctccaccgccgagaacgagatgaagcccgactccctcctcgccggcatcgagaacggcaagctcaagttccgcttcgagaccgccgacaagtacatcgagttcgcccagcagaacggcatggtcgtccgcggccacaccctcgtctggcacaaccagacccccgagtggttcttcaaggacgagaacggcaacctcctctccaaggaggagatgaccgagcgcctccgcgagtacatccacaccgtcgtcggccacttcaagggcaaggtctacgcctgggacgtcgtcaacgaggccgtcgaccccaaccagcccgacggcctccgccgctccacctggtaccagatcatgggccccgactacatcgagctcgccttcaagttcgcccgcgaggccgaccccaacgccaagctcttctacaacgactacaacaccttcgagcccaagaagcgcgacatcatctacaacctcgtcaagtccctcaaggagaagggcctcatcgacggcatcggcatgcagtgccacatctccctcgccaccgacatccgccagatcgaggaggccatcaagaagttctccaccatccccggcatcgagatccacatcaccgagctcgacatctccgtctaccgcgactccacctccaactactccgaggccccccgcaccgccctcatcgagcaggcccacaagatggcccagctcttcaagatcttcaagaagtactccaacgtcatcaccaacgtcaccttctggggcctcaaggacgactactcctggcgcgccacccgccgcaacgactggcccctcatcttcgacaaggactaccaggccaagctcgcctactgggccatcgtcgcccccgaggtcctcccccccctccccaaggagtccaagatctccgagggcgaggccgtcgtcgtcggcatgatggacgactcctacatgatgtccaagcccatcgagatctacgacgaggagggcaacgtcaaggccaccatccgcgccatctggaaggactccaccatctacgtctacggcgaggtccaggacgccaccaagaagcccgccgaggacggcgtcgccatcttcatcaaccccaacaacgagcgcaccccctacctccagcccgacgacacctacgtcgtcctctggaccaactggaagtccgaggtcaaccgcgaggacgtcgaggtcaagaagttcgtcggccccggcttccgccgctactccttcgagatgtccatcaccatccccggcgtcgagttcaagaaggactcctacatcggcttcgacgtcgccgtcatcgacgacggcaagtggtactcctggtccgacaccaccaactcccagaagaccaacaccatgaactacggcaccctcaagctcgagggcgtcatggtcgccaccgccaagtacggcacccccgtcatcgacggcgagatcgacgacatctggaacaccaccgaggagatcgagaccaagtccgtcgccatgggctccctcgagaagaacgccaccgccaaggtccgcgtcctctgggacgaggagaacctctacgtcctcgccatcgtcaaggaccccgtcctcaacaaggacaactccaacccctgggagcaggactccgtcgagatcttcatcgacgagaacaaccacaagaccggctactacgaggacgacgacgcccagttccgcgtcaactacatgaacgagcagtccttcggcaccggcgcctccgccgcccgcttcaagaccgccgtcaagctcatcgagggcggctacatcgtcgaggccgccatcaagtggaagaccatcaagccctcccccaacaccgtcatcggcttcaacgtccaggtcaacgacgccaacgagaagggccagcgcgtcggcatcatctcctggtccgaccccaccaacaactcctggcgcgacccctccaagttcggcaacctccgcctcatcaag

SEQ ID NO: 20821 - RNA, 3165 nt, synthetic construct; identical to SEQ ID NO: 20820
  misc_feature 1..3165: note = derived and/or modified sequence opt2 from anti-influenza_Chain
  source 1..3165: mol_type = other RNA

SEQ ID NO: 20822 - RNA, 3177 nt, synthetic construct
  misc_feature 1..3177: note = derived and/or modified sequence opt2 from anti-influenza_Chain
  source 1..3177: mol_type = other RNA
atgcaggtccgcaagcgccgcggcctcctcgacgtctccaccgccgtcctcgtcggcatcctcgccggcttcctcggcgtcgtcctcgccgcctccggcgtcctctccttcggcaaggaggcctcctccaagggcgactcctccctcgagaccgtcctcgccctctccttcgagggcaccaccgagggcgtcgtccccttcggcaaggacgtcgtcctcaccgcctcccaggacgtcgccgccgacggcgagtactccctcaaggtcgagaaccgcacctccccctgggacggcgtcgagatcgacctcaccggcaaggtcaagtccggcgccgactacctcctctccttccaggtctaccagtcctccgacgccccccagctcttcaacgtcgtcgcccgcaccgaggacgagaagggcgagcgctacgacgtcatcctcgacaaggtcgtcgtctccgaccactggaaggagatcctcgtccccttctcccccaccttcgagggcacccccgccaagtactccctcatcatcgtcgcctccaagaacaccaacttcaacttctacctcgacaaggtccaggtcctcgcccccaaggagtccggccccaaggtcatctacgagacctccttcgagaacggcgtcggcgactggcagccccgcggcgacgtcaacatcgaggcctcctccgaggtcgcccactccggcaagtcctccctcttcatctccaaccgccagaagggctggcagggcgcccagatcaacctcaagggcatcctcaagaccggcaagacctacgccttcgaggcctgggtctaccagaactccggccaggaccagaccatcatcatgaccatgcagcgcaagtactcctccgacgcctccacccagtacgagtggatcaagtccgccaccgtcccctccggccagtgggtccagctctccggcacctacaccatccccgccggcgtcaccgtcgaggacctcaccctctacttcgagtcccagaaccccaccctcgagttctacgtcgacgacgtcaagatcgtcgacaccacctccgccgagatcaagatcgagatggagcccgagaaggagatccccgccctcaaggaggtcctcaaggactacttcaaggtcggcgtcgccctcccctccaaggtcttcctcaaccccaaggacatcgagctcatcaccaagcacttcaactccatcaccgccgagaacgagatgaagcccgagtccctcctcgccggcatcgagaacggcaagctcaagttccgcttcgagaccgccgacaagtacatccagttcgtcgaggagaacggcatggtcatccgcggccacaccctcgtctggcacaaccagacccccgactggttcttcaaggacgagaacggcaacctcctctccaaggaggccatgaccgagcgcctcaaggagtacatccacaccgtcgtcggccacttcaagggcaaggtctacgcctgggacgtcgtcaacgaggccgtcgaccccaaccagcccgacggcctccgccgctccacctggtaccagatcatgggccccgactacatcgagctcgccttcaagttcgcccgcgaggccgaccccgacgccaagctcttctacaacgactacaacaccttcgagccccgcaagcgcgacatcatctacaacctcgtcaaggacctcaaggagaagggcctcatcgacggcatcggcatgcagtgccacatctccctcgccaccgacatcaagcagatcgaggaggccatcaagaagttctccaccatccccggcatcgagatccacatcaccgagctcgacatgtccgtctaccgcgactcctcctccaactaccccgaggccccccgcaccgccctcatcgagcaggcccacaagatgatgcagctcttcgagatcttcaagaagtactccaacgtcatcaccaacgtcaccttctggggcctcaaggacgactactcctggcgcgccacccgccgcaacgactggcccctcatcttcgacaaggaccaccaggccaagctcgcctactgggccatcgtcgcccccgaggtcctcccccccctccccaaggagtcccgcatctccgagggcgaggccgtcgtcgtcggcatgatggacgactcctacctcatgtccaagcccatcgagatcctcgacgaggagggcaacgtcaaggccaccatccgcgccgtctggaaggactccaccatctacatctacggcgaggtccaggacaagaccaagaagcccgccgaggacggcgtcgccatcttcatcaaccccaacaacgagcgcaccccctacctccagcccgacgacacctacgccgtcctctggaccaactggaagaccgaggtcaaccgcgaggacgtccaggtcaagaagttcgtcggccccggcttccgccgctactccttcgagatgtccatcaccatccccggcgtcgagttcaagaaggactcctacatcggcttcgacgccgccgtcatcgacgacggcaagtggtactcctggtccgacaccaccaactcccagaagaccaacaccatgaactacggcaccctcaagctcgagggcatcatggtcgccaccgccaagtacggcacccccgtcatcgacggcgagatcgacgagatctggaacaccaccgaggagatcgagaccaaggccgtcgccatgggctccctcgacaagaacgccaccgccaaggtccgcgtcctctgggacgagaactacctctacgtcctcgccatcgtcaaggaccccgtcctcaacaaggacaactccaacccctgggagcaggactccgtcgagatcttcatcgacgagaacaaccacaagaccggctactacgaggacgacgacgcccagttccgcgtcaactacatgaacgagcagaccttcggcaccggcggctcccccgcccgcttcaagaccgccgtcaagctcatcgagggcggctacatcgtcgaggccgccatcaagtggaagaccatcaagcccacccccaacaccgtcatcggcttcaacatccaggtcaacgacgccaacgagaagggccagcgcgtcggcatcatctcctggtccgaccccaccaacaactcctggcgcgacccctccaagttcggcaacctccgcctcatcaag

SEQ ID NO: 20823 - RNA, 3177 nt, synthetic construct; identical to SEQ ID NO: 20822
  misc_feature 1..3177: note = derived and/or modified sequence opt2 from anti-influenza_Chain
  source 1..3177: mol_type = other RNA

SEQ ID NO: 20824 - RNA, 318 nt, synthetic construct
  misc_feature 1..318: note = derived and/or modified sequence opt2 from anti-OX40_LightChain
  source 1..318: mol_type = other RNA
gagatcgtcgtcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccaccttcggccagggcaccaaggtcgagatcaag

SEQ ID NO: 20825 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccagggcatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctacccccccaccttcggcggcggcaccaaggtcgagatcaag

SEQ ID NO: 20826 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcagggccacaccctcccccccaccttcggccagggcaccaaggtcgagatcaag

SEQ ID NO: 20827 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaagaccgtcaagctcctcatctactacacctcccgcctccgctccggcgtcccctcccgcttctccggctccggctccggcaccgacttcaccctcaccatctcctccctccagcccgaggacttcgccacctactactgccagcagggccacaccctcccccccaccttcggccagggcaccaaggtcgagatcaag

SEQ ID NO: 20828 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaagaccgtcaagctcctcatctactacacctcccgcctccgctccggcgtcccctcccgcttctccggctccggctccggcaaggactacaccctcaccatctcctccctccagcccgaggacttcgccacctacttctgccagcagggccacaccctcccccccaccttcggccagggcaccaaggtcgagatcaag

SEQ ID NO: 20829 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcagggccacaccctccccgccaccttcggccagggcaccaaggtcgagatcaag

SEQ ID NO: 20830 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcagggccacaccgccccccccaccttcggccagggcaccaaggtcgagatcaag

SEQ ID NO: 20831 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcagggcgccaccctcccccccaccttcggccagggcaccaaggtcgagatcaag

SEQ ID NO: 20832 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcagggccacgccctcccccccaccttcggccagggcaccaaggtcgagatcaag

SEQ ID NO: 20833 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcaggcccacaccctcccccccaccttcggccagggcaccaaggtcgagatcaag

SEQ ID NO: 20834 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccagcagggccacaccctcgcccccaccttcggccagggcaccaaggtcgagatcaag

SEQ ID NO: 20835 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctcccgcctccgctccggcgtcccctcccgcttctccggctccggctccggcaccgacttcaccctcaccatctcctccctccagcccgaggacttcgccacctactactgccaggccggccacaccctcccccccaccttcggccagggcaccaaggtcgagatcaag

SEQ ID NO: 20836 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggcccccaagctcctcatctactacacctccaagctccactccggcgtcccctcccgcttctccggctccggctccggcaccgactacaccctcaccatctcctccctccagcccgaggacttcgccacctactactgccagcagggctccgccctcccctggaccttcggccagggcaccaaggtcgagatcaag

SEQ ID NO: 20837 - RNA, 321 nt, synthetic construct
  misc_feature 1..321: note = derived and/or modified sequence opt2 from anti-OX40_LightChain
  source 1..321: mol_type = other RNA
gacatccagatgacccagtccccctcctccctctccgcctccgtcggcgaccgcgtcaccatcacctgccgcgcctcccaggacatctccaactacctcaactggtaccagcagaagcccggcaaggccgtcaagctcctcatctactacacctccaagctccactccggcgtcccctcccgcttctccggctccggctcccgcaccgactacaccctcaccatctcctccctccagcccgaggacttcgccacctactactgccagcagggctccgccctcccctggaccttcggccagggcaccaaggtcgagatcaag

SEQ ID NO: 20838 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20839 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccatcaccgtcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20840 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccctcaccgtcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20841 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgacgcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20842 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgagtcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20843 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacgccgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20844 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacgccgacgcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20845 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgacgcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20846 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgactccggcgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20847 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggctcctcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20848 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgacgcctacatgtcctgggtccgccaggcccccggccagggcctcgagtggatcggcgacatgtaccccgacaacgccgacgcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgtctggggccagggcaccctcgtcaccgtctcctcc

SEQ ID NO: 20849 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttctccgcctggggccagggcaccctcgtcaccgtctcctcc

SEQ ID NO: 20850 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgtcctcgccccccgctggtacttcgccgtctggggccagggcaccctcgtcaccgtctcctcc

SEQ ID NO: 20851 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgccctcgccccccgctggtacttctccgtctggggccagggcaccctcgtcaccgtctcctcc

SEQ ID NO: 20852 - RNA, 351 nt, synthetic construct
  misc_feature 1..351: note = derived and/or modified sequence opt2 from anti-OX40_HeavyChain
  source 1..351: mol_type = other RNA
gaggtccagctcgtccagtccggcgccgaggtcaagaagcccggcgcctccgtcaaggtctcctgcaaggcctccggctacaccttcaccgactcctacatgtcctgggtccgccaggcccccggccagggcctcgagtggatcggcgacatgtaccccgacaacggcgactcctcctacaaccagaagttccgcgagcgcgtcaccatcacccgcgacacctccacctccaccgcctacctcgagctctcctccctccgctccgaggacaccgccgtctactactgcgtcgccgccccccgctggtacttctccgtctggggccagggcaccctcgtcaccgtctcctcc

SEQ ID NO: 20853 - RNA, 354 nt, synthetic construct
  misc_feature 1..354: note = derived and/or modified sequence opt2 from anti-OX40_HeavyChain
  source 1..354: mol_type = other RNA
gaggtccagctcgtcgagtccggcggcggcctcgtccagcccggcggctccctccgcctctcctgcgccgcctccggcttcaccttctcctcctactccatgaactgggtccgccaggcccccggcaagggcctcgagtgggtctcctacatctcctcctcctcctccaccatcgactacgccgactccgtcaagggccgcttcaccatctcccgcgacaacgccaagaactccctctacctccagatgaactccctccgcgacgaggacaccgccgtctactactgcgcccgcgagtccggctggtacctcttcgactactggggccagggcaccctcgtcaccgtctcctcc

SEQ ID NO: 20854 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgccagcaccccggcaagggcctcgagtggatcggctacatctcctacaacggcatcacctaccacaacccctccctcaagtcccgcatcaccatcaaccccgacacctccaagaaccagttctccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20855 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtggatcggctacatctcctacaacggcatcacctaccacaacccctccctcaagtcccgcatcaccatcaaccgcgacacctccaagaaccagttctccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20856 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcgactccttctcctccggctactggaactggatccgcaagcaccccggcaagggcctcgagtacatgggctacatctcctacaacggcatcacctaccacaacccctccctcaagtcccgcatcaccatcaaccgcgacacctccaagaaccagtactccctccagctcaactccgtcacccccgaggacaccgccgtctacttctgcgcccgctaccgctacgactacgacggcggccacgccatggactactggggccagggcaccctcgtcaccgtctcctcc

SEQ ID NO: 20857 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcgactccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagtactccctccagctcaactccgtcacccccgaggacaccgccgtctacttctgcgcccgctaccgctacgactacgacggcggccacgccatggactactggggccagggcaccctcgtcaccgtctcctcc

SEQ ID NO: 20858 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcgactccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagttctccctccagctcaactccgtcacccccgaggacaccgccgtctacttctgcgcccgctaccgctacgactacgacggcggccacgccatggactactggggccagggcaccctcgtcaccgtctcctcc

SEQ ID NO: 20859 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcgactccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagtactccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20860 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcgactccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagttctccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20861 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacggcatcacctaccacaacccctccctcaagtcccgcatcaccatcaaccccgacacctccaagaaccagtactccctccagctcaactccgtcacccccgaggacaccgccgtctacttctgcgcccgctaccgctacgactacgacggcggccacgccatggactactggggccagggcaccctcgtcaccgtctcctcc

SEQ ID NO: 20862 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagtactccctccagctcaactccgtcacccccgaggacaccgccgtctacttctgcgcccgctaccgctacgactacgacggcggccacgccatggactactggggccagggcaccctcgtcaccgtctcctcc

SEQ ID NO: 20863 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagtactccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20864 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacggcatcacctaccacaacccctccctcaagtcccgcatcaccatcaaccccgacacctccaagaaccagtactccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20865 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacgccatcacctaccacaacccctccctcaagtcccgcatcaccatcaaccgcgacacctccaagaaccagtactccctccagctcaactccgtcacccccgaggacaccgccgtctactactgcgcccgctacaagtacgactacgacgccggccacgccatggactactggggccagggcaccctcgtcaccgtctcctcc

SEQ ID NO: 20866 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacgccatcacctaccacaacccctccctcaagtcccgcatcaccatcaaccgcgacacctccaagaaccagtactccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20867 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacggcatcacctaccacaacccctccctcaagtcccgcatcaccatcaaccgcgacacctccaagaaccagtactccctccagctcaactccgtcacccccgaggacaccgccgtctactactgcgcccgctacaagtacgactacgacggcggccacgccatggactactggggccagggcaccctcgtcaccgtctcctcc

SEQ ID NO: 20868 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctactccggcatcacctaccacaacccctccctcaagtcccgcatcaccatcaaccgcgacacctccaagaaccagtactccctccagctcaactccgtcacccccgaggacaccgccgtctactactgcgcccgctaccgctacgactacgacggcggccacgccatggactactggggccagggcaccctcgtcaccgtctcctcc

SEQ ID NO: 20869 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctactccggcatcacctaccacaacccctccctcaagtcccgcatcaccatcaaccgcgacacctccaagaaccagtactccctccagctcaactccgtcacccccgaggacaccgccgtctactactgcgcccgctacaagtacgactacgacggcggccacgccatggactactggggccagggcaccctcgtcaccgtctcctcc

SEQ ID NO: 20870 - RNA, 363 nt, synthetic construct
  misc_feature 1..363: note = derived and/or modified sequence opt2 from anti-OX40_HeavyChain
  source 1..363: mol_type = other RNA
gaggtccagctccaggagtccggcccctccctcgtcaagccctcccagaccctctccctcacctgctccgtcaccggcgactccttcacctccggctactggaactggatccgcaagttccccggcaaccgcctcgagtacatgggctacatctcctacaacgccatcacctaccacaacccctccctcaagtcccgcatctccatcacccgcgacacctccaagaaccactactacctccagctcaactccgtcaccaccgaggacaccgccacctacttctgcgcccgctaccgctacgactacgacggcggccacgccatggactactggggccagggcaccctcgtcaccgtctcctcc

SEQ ID NO: 20871 - RNA, 363 nt, synthetic construct
  misc_feature 1..363: note = derived and/or modified sequence opt2 from anti-OX40_HeavyChain
  source 1..363: mol_type = other RNA
caggtccagctccaggagtccggccccggcctcgtcaagccctcccagaccctctccctcacctgcgccgtctacggcggctccttctcctccggctactggaactggatccgcaagcaccccggcaagggcctcgagtacatcggctacatctcctacaacgccatcacctaccacaacccctccctcaagtcccgcatcaccatcaaccgcgacacctccaagaaccagtactccctccagctcaactccgtcacccccgaggacaccgccgtctactactgcgcccgctacaagtacgactacgacggcggccacgccatggactactggggccagggcaccctcgtcaccgtctcctcc

SEQ ID NO: 20872 - RNA, 372 nt, synthetic construct
  misc_feature 1..372: note = derived and/or modified sequence opt2 from anti-OX40_HeavyChain
  source 1..372: mol_type = other RNA
gaggtccagctcgtcgagtccggcggcggcctcgtccagcccggccgctccctccgcctctcctgcgccgcctccggcttcaccttcgacgactacgccatgcactgggtccgccaggcccccggcaagggcctcgagtgggtctccggcatctcctggaactccggctccatcggctacgccgactccgtcaagggccgcttcaccatctcccgcgacaacgccaagaactccctctacctccagatgaactccctccgcgccgaggacaccgccctctactactgcgccaaggaccagtccaccgccgactactacttctactacggcatggacgtctggggccagggcaccaccgtcaccgtctcctcc

SEQ ID NO: 20873 - RNA, 381 nt, synthetic construct
  misc_feature 1..381: note = derived and/or modified sequence opt2 from anti-OX40_LightChain
  source 1..381: mol_type = other RNA
atggagacccccgcccagctcctcttcctcctcctcctctggctccccgacaccaccggcgagatcgtcctcacccagtcccccggcaccctctccctctcccccggcgagcgcgccatcctctcctgccgcgcctcccagtccgtctcctcctccttcctcgcctggtaccagcagaagcccggccaggccccccgcctcctcatctacggcgccttctcccgcgccaccggcatccccgaccgcttctccggctccggctccggcaccgacttcaccctcaccatctcccgcctcgagcccgaggacttcgccgtctactactgccagcagtacgactcctcccgcaccttcggccagggcaccaaggtcgagatcaag

SEQ ID NO: 20874 - RNA, 381 nt, synthetic construct
  misc_feature 1..381: note = derived and/or modified sequence opt2 from anti-OX40_LightChain
  source 1..381: mol_type = other RNA
atggaggcccccgcccagctcctcttcctcctcctcctctggctccccgacaccaccggcgagatcgtcctcacccagtcccccgccaccctctccctctcccccggcgagcgcgccaccctctcctgccgcgcctcccagggcgtctcctcctacctcgcctggtaccagcagaagcccggccaggccccccgcctcctcatctacgacgcctccaaccgcgccaccggcatccccgcccgcttctccggctccggccccggcaccgacttcaccctcaccatctcctccctcgagcccgaggacttcgccgtctactactgccagcagcgctccaactggcaccccaccttcggccagggcaccaaggtcgagatcaag

SEQ ID NO: 20875 - RNA, 381 nt, synthetic construct
  misc_feature 1..381: note = derived and/or modified sequence opt2 from anti-OX40_LightChain
  source 1..381: mol_type = other RNA
atggaggcccccgcccagctcctcttcctcctcctcctctggctccccgacaccaccggcgagatcgtcctcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccatcaccttcggccagggcacccgcctcgagatcaag

SEQ ID NO: 20876 - RNA, 387 nt, synthetic construct
  misc_feature 1..387: note = derived and/or modified sequence opt2 from anti-OX40_LightChain
  source 1..387: mol_type = other RNA
atggagacccccgcccagctcctcttcctcctcctcctctggctccccgacaccaccggcgagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctcctcccgcgccaccggcatccccgaccgcttctccggctccggctccggcaccgacttcaccctcaccatctcccgcctcgagcccgaggacttcgccgtctactactgccagcagtacgactcctccctcaccttcggcggcggcaccaaggtcgagatcaagcgcacc

SEQ ID NO: 20877 - RNA, 390 nt, synthetic construct
  misc_feature 1..390: note = derived and/or modified sequence opt2 from anti-OX40_LightChain
  source 1..390: mol_type = other RNA
atggacatgcgcgtcctcgcccagctcctcggcctcctcctcctctgcttccccggcgcccgctgcgacatccagatgacccagtccccctcctccctctccgcctccgtcggcaaccgcgtcaccatcacctgccgcgcctcccaggacatctcctcctggctcgcctggtaccagcagaagcccgagaaggcccccaagtccctcatctacgccgcctcctccctccagtccggcgtcccctcccgcttctccggctccggctccggcaccgacttcaccctcaccatctcctccctccagcccgaggacttcgccacctactactgccagcagtacaactcctaccccctcaccttcggccagggcacccgcctcgagatcaagcgc

SEQ ID NO: 20878 - RNA, 408 nt, synthetic construct
  misc_feature 1..408: note = derived and/or modified sequence opt2 from anti-OX40_HeavyChain
  source 1..408: mol_type = other RNA
atggacaccctctgctccaccctcctcctcctcaccatcccctcctgggtcctctcccagatcaccctcaaggagtccggccccaccctcgtcaagcccacccagaccctcaccctctcctgcaccttctccggcttctccctctccacctccggcgtcggcgtcggctggatccgccagccccccggcaaggccctcgagtggctcgccctcatccactgggacgacgccgagcgctactccccctccctcaagtcccgcctcaccatcaccaaggacacctccaagaaccaggtcgtcctcaccatgaccaacatggacctcgtcgacaccgccacctactactgcgcccacacccgcggcgccttcgacatctggggccagggcaccatggtcaccgtctcctcc

SEQ ID NO: 20879 - RNA, 408 nt, synthetic construct
  misc_feature 1..408: note = derived and/or modified sequence opt2 from anti-OX40_HeavyChain
  source 1..408: mol_type = other RNA
atggacaccctctgctccaccctcctcctcctcaccatcccctcctgggtcctctcccagatcaccctcaaggagtccggccccaccctcgtcaagcccacccagaccctcaccctcacctgcaccttctccggcttctccctctccacctccggcgtcggcgtcggctggatccgccagccccccggcaaggccctcgagtggctcgccctcatctactgggacgaccactccccctactccccctccctcaagtcccgcctcaccatcaccaaggacacctccaagaaccaggtcgtcctcaccatgaccaacatggaccccgtcgacaccgccacctactactgcgcccgcacccgcggcgccttcgacatctggggccagggcaccatggtcaccgtctcctcc

SEQ ID NO: 20880 - RNA, 420 nt, synthetic construct
  misc_feature 1..420: note = derived and/or modified sequence opt2 from anti-OX40_HeavyChain
  source 1..420: mol_type = other RNA
atggagtggggcccctgctgggtcttcctcgtcgtcatcctcgagggcgtccagtgcggcgtccagctcgtcgagtccggcggcggcctcgtccagcccggcggctccctccgcctctcctgcgccgcctccggcttcaccttctcctcctactccatgaactgggtccgccaggcccccggcaagggcctcgagtgggtctcctacatctcctcctcctcctccaccatctactacgccgactccgtcaagggccgcttcaccatctcccgcgacaacgccaagaactccctctacctccagatgaactccctccgcgacgaggacaccgccgtctactactgcgcccgcggcgtctaccacaacggctggtccttcttcgactactggggccagggcaccctcctcaccgtctcctcc

SEQ ID NO: 20881 - RNA, 423 nt, synthetic construct
  misc_feature 1..423: note = derived and/or modified sequence opt2 from anti-OX40_HeavyChain
  source 1..423: mol_type = other RNA
atggacaccctctgctccaccctcctcctcctcaccatcccctcctgggtcctctcccagatcaccctcaaggagtccggccccaccctcgtcaagcccaagcagaccctcaccctcacctgcaccttctccggcttctccctctccacctccggcatgggcgtcggctggatccgccagccccccggcaaggccctcgagtggctcgccgtcatctactgggacgaccaccagctctactccccctccctcaagtcccgcctcaccatcaccaaggacacctccaagaaccaggtcgtcctcaccatgaccaacatggaccccgtcgacaccgccacctactactgcgcccaccgccgcggcgccttccagcactggggccagggcaccctcgtcaccgtctcctccgcctccaccaagggc

SEQ ID NO: 20882 - RNA, 462 nt, synthetic construct
  misc_feature 1..462: note = derived and/or modified sequence opt2 from anti-OX40_HeavyChain
  source 1..462: mol_type = other RNA
atgaccatgatcaccccctccctcgtcccctcctccgaccccctcgtcaccgccgcctccgtcctcgagttcgccctcctcatccgcctcaccatcggccaggccgtcgtctccacccagtccaccggcggcggcctcgtccagcccggccgctccctccgcctctcctgcgccgcctccggcttcaccctcgacgactacggcatgcactgggtccgccaggcccccggcaagggcctcgagtgggtctccggcatctcctggaactccgactccatcggctacgtcgactccgtcaagggccgcttcaccatctcccgcgacaacgccaagaactccctctacctccagatgaactccctccgcgtcgaggacaccgccctctactactgcgtcaaggacatctccggctggtactccttcgactactggggccagggcaccctcgtcaccgtctcctcc

SEQ ID NO: 20883 - RNA, 639 nt, synthetic construct
  misc_feature 1..639: note = derived and/or modified sequence opt2 from anti-OX40_LightChain
  source 1..639: mol_type = other RNA
gagatcgtcgtcacccagtcccccgccaccctctccctctcccccggcgagcgcgccaccctctcctgccgcgcctcccagtccgtctcctcctacctcgcctggtaccagcagaagcccggccaggccccccgcctcctcatctacgacgcctccaaccgcgccaccggcatccccgcccgcttctccggctccggctccggcaccgacttcaccctcaccatctcctccctcgagcccgaggacttcgccgtctactactgccagcagcgctccaactggcccaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 20884 - RNA, 1350 nt, synthetic construct
  misc_feature 1..1350: note = derived and/or modified sequence opt2 from anti-OX40_HeavyChain
  source 1..1350: mol_type = other RNA
gaggtccagctcgtcgagtccggcggcggcctcgtccagcccggccgctccctccgcctctcctgcgccgcctccggcttcaccttcgacgactacgccatgcactgggtccgccaggcccccggcaagggcctcgagtgggtctccggcatctcctggaactccggctccatcggctacgccgactccgtcaagggccgcttcaccatctcccgcgacaacgccaagaactccctctacctccagatgaactccctccgcgccgaggacaccgccctctactactgcgccaaggaccagtccaccgccgactactacttctactacggcatggacgtctggggccagggcaccaccgtcaccgtctcctccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtcgagcgcaagtgctgcgtcgagtgccccccctgccccgccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 20885 - RNA, 21 nt, synthetic construct
  misc_feature 1..21: note = derived and/or modified sequence opt2 from anti-HIV_VRC01_VRC02_NIH45-46_LightChain_CDR
  source 1..21: mol_type = other RNA
tgccagcagtacgagttcttc

SEQ ID NO: 20886 - RNA, 42 nt, synthetic construct; identical to SEQ ID NO: 13244
  misc_feature 1..42: note = derived and/or modified sequence opt2 from anti-HIV_VRC01_HeavyChain_CDR
  source 1..42: mol_type = other RNA

SEQ ID NO: 20887 - RNA, 21 nt, synthetic construct
  misc_feature 1..21: note = derived and/or modified sequence opt2 from anti-HIV_3BNC60_LightChain_CDR
  source 1..21: mol_type = other RNA
tgccaggtctacgagttcatc

SEQ ID NO: 20888 - RNA, 36 nt, synthetic construct
  misc_feature 1..36: note = derived and/or modified sequence opt2 from anti-HIV_3BNC60_HeavyChain_CDR
  source 1..36: mol_type = other RNA
gcccgccagcgctccgacttctgggacttcgacgtc

SEQ ID NO: 20889 - RNA, 36 nt, synthetic construct
  misc_feature 1..36: note = derived and/or modified sequence opt2 from anti-HIV_5H/I1-BMV-D5_HeavyChain_CDR
  source 1..36: mol_type = other RNA
gcccgcgacaaccccaccctcctcggctccgactac

SEQ ID NO: 20890 - RNA, 33 nt, synthetic construct; identical to SEQ ID NO: 13248
  misc_feature 1..33: note = derived and/or modified sequence opt2 from anti-HIV_8ANC195_LightChain_CDR
  source 1..33: mol_type = other RNA

SEQ ID NO: 20891 - RNA, 33 nt, synthetic construct
  misc_feature 1..33: note = derived and/or modified sequence opt2 from anti-HIV_CH01_CH02_CH03_LightChain_CDR
  source 1..33: mol_type = other RNA
tgccagcagtacggcggctccccctacaccttc

SEQ ID NO: 20892 - RNA, 78 nt, synthetic construct
  misc_feature 1..78: note = derived and/or modified sequence opt2 from anti-HIV_CH01_HeavyChain_CDR
  source 1..78: mol_type = other RNA
gcccgcggcaccgactacaccatcgacgacgccggcatccactaccagggctccggcaccttctggtacttcgacctc

SEQ ID NO: 20893 - RNA, 78 nt, synthetic construct
  misc_feature 1..78: note = derived and/or modified sequence opt2 from anti-HIV_CH02_HeavyChain_CDR
  source 1..78: mol_type = other RNA
gcccgcggcaccgactacaccatcgacgaccagggccgcttctaccagggctccggcaccttctggtacttcgacttc

SEQ ID NO: 20894 - RNA, 78 nt, synthetic construct
  misc_feature 1..78: note = derived and/or modified sequence opt2 from anti-HIV_CH03_HeavyChain_CDR
  source 1..78: mol_type = other RNA
gcccgcggcaccgactacaccatcgacgaccagggcatcttctacaagggctccggcaccttctggtacttcgacctc

SEQ ID NO: 20895 - RNA, 33 nt, synthetic construct
  misc_feature 1..33: note = derived and/or modified sequence opt2 from anti-HIV_CH04_LightChain_CDR
  source 1..33: mol_type = other RNA
tgccagcagtacggccgctccccctacaccttc

SEQ ID NO: 20896 - RNA, 78 nt, synthetic construct
  misc_feature 1..78: note = derived and/or modified sequence opt2 from anti-HIV_CH04_HeavyChain_CDR
  source 1..78: mol_type = other RNA
gcccgcggcaccgactacaccatcgacgaccagggcatccgctaccagggctccggcaccttctggtacttcgacgtc

SEQ ID NO: 20897 - RNA, 54 nt, synthetic construct
  misc_feature 1..54: note = derived and/or modified sequence opt2 from anti-HIV_NIH45-46_HeavyChain_CDR
  source 1..54: mol_type = other RNA
acccgcggcaagtactgcaccgcccgcgactactacaactgggacttcgagcac

SEQ ID NO: 20898 - RNA, 90 nt, synthetic construct
  misc_feature 1..90: note = derived and/or modified sequence opt2 from anti-HIV_PG16_HeavyChain_CDR
  source 1..90: mol_type = other RNA
gcccgcgaggccggcggccccatctggcacgacgacgtcaagtactacgacttcaacgacggctactacaactaccactacatggacgtc

SEQ ID NO: 20899 - RNA, 36 nt, synthetic construct
  misc_feature 1..36: note = derived and/or modified sequence opt2 from anti-HIV_PGT122_LightChain_CDR
  source 1..36: mol_type = other RNA
cacatctgggactcccgccgccccaccaactgggtc

SEQ ID NO: 20900 - RNA, 72 nt, synthetic construct
  misc_feature 1..72: note = derived and/or modified sequence opt2 from anti-HIV_PGT122_HeavyChain_CDR
  source 1..72: mol_type = other RNA
accaagcacggccgccgcatctacggcgtcgtcgccttcaaggagtggttcacctacttctacatggacgtc

SEQ ID NO: 20901 - RNA, 36 nt, synthetic construct
  misc_feature 1..36: note = derived and/or modified sequence opt2 from anti-HIV_PGT123_LightChain_CDR
  source 1..36: mol_type = other RNA
cacatctacgacgcccgcggcggcaccaactgggtc

SEQ ID NO: 20902 - RNA, 72 nt, synthetic construct
  misc_feature 1..72: note = derived and/or modified sequence opt2 from anti-HIV_PGT123_HeavyChain_CDR
  source 1..72: mol_type = other RNA
gccctccacggcaagcgcatctacggcatcgtcgccctcggcgagctcttcacctacttctacatggacgtc

SEQ ID NO: 20903 - RNA, 30 nt, synthetic construct
  misc_feature 1..30: note = derived and/or modified sequence opt2 from anti-HIV_PGT125_PGT128_LightChain_CDR
  source 1..30: mol_type = other RNA
ggctccctcgtcggcaactgggacgtcatc

SEQ ID NO: 20904 - RNA, 57 nt, synthetic construct
  misc_feature 1..57: note = derived and/or modified sequence opt2 from anti-HIV_PGT125_HeavyChain_CDR
  source 1..57: mol_type = other RNA
ttcgacggcgaggtcctcgtctacaaccactggcccaagcccgcctgggtcgacctc

SEQ ID NO: 20905 - RNA, 30 nt, synthetic construct
  misc_feature 1..30: note = derived and/or modified sequence opt2 from anti-HIV_PGT126_PGT127_LightChain_CDR
  source 1..30: mol_type = other RNA
tcctccctcgtcggcaactgggacgtcatc

SEQ ID NO: 20906 - RNA, 57 nt, synthetic construct
  misc_feature 1..57: note = derived and/or modified sequence opt2 from anti-HIV_PGT126_HeavyChain_CDR
  source 1..57: mol_type = other RNA
ttcgacggcgaggtcctcgtctaccacgactggcccaagcccgcctgggtcgacctc

SEQ ID NO: 20907 - RNA, 57 nt, synthetic construct
  misc_feature 1..57: note = derived and/or modified sequence opt2 from anti-HIV_PGT127_HeavyChain_CDR
  source 1..57: mol_type = other RNA
ttcggcggcgaggtcctcgtctaccgcgactggcccaagcccgcctgggtcgacctc

SEQ ID NO: 20908 - RNA, 57 nt, synthetic construct
  misc_feature 1..57: note = derived and/or modified sequence opt2 from anti-HIV_PGT128_HeavyChain_CDR
  source 1..57: mol_type = other RNA
ttcggcggcgaggtcctccgctacaccgactggcccaagcccgcctgggtcgacctc

SEQ ID NO: 20909 - RNA, 30 nt, synthetic construct
  misc_feature 1..30: note = derived and/or modified sequence opt2 from anti-HIV_PGT130_LightChain_CDR
  source 1..30: mol_type = other RNA
tcctccctcttcggccgctgggacgtcgtc

SEQ ID NO: 20910 - RNA, 57 nt, synthetic construct
  misc_feature 1..57: note = derived and/or modified sequence opt2 from anti-HIV_PGT130_HeavyChain_CDR
  source 1..57: mol_type = other RNA
tccggcggcgacatcctctactactacgagtggcagaagccccactggttctccccc

SEQ ID NO: 20911 - RNA, 30 nt, synthetic construct
  misc_feature 1..30: note = derived and/or modified sequence opt2 from anti-HIV_PGT131_LightChain_CDR
  source 1..30: mol_type = other RNA
tcctccctctccggccgctgggacatcgtc

SEQ ID NO: 20912 - RNA, 57 nt, synthetic construct
  misc_feature 1..57: note = derived and/or modified sequence opt2 from anti-HIV_PGT131_HeavyChain_CDR
  source 1..57: mol_type = other RNA
tccggcggcgacatcctctactacatcgagtggcagaagccccactggttctacccc

SEQ ID NO: 20913 - RNA, 27 nt, synthetic construct
  misc_feature 1..27: note = derived and/or modified sequence opt2 from anti-HIV_PGT135_PGT136_PGT137_LightChain_CDR
  source 1..27: mol_type = other RNA
cagcagtacgaggagtggccccgcacc

SEQ ID NO: 20914 - RNA, 54 nt, synthetic construct
  misc_feature 1..54: note = derived and/or modified sequence opt2 from anti-HIV_PGT135_HeavyChain_CDR
  source 1..54: mol_type = other RNA
caccgccaccacgacgtcttcatgctcgtccccatcgccggctggttcgacgtc

SEQ ID NO: 20915 - RNA, 54 nt, synthetic construct
  misc_feature 1..54: note = derived and/or modified sequence opt2 from anti-HIV_PGT136_HeavyChain_CDR
  source 1..54: mol_type = other RNA
cacaagtaccacgacatcttccgcgtcgtccccgtcgccggctggttcgacccc

SEQ ID NO: 20916 - RNA, 54 nt, synthetic construct
  misc_feature 1..54: note = derived and/or modified sequence opt2 from anti-HIV_PGT137_HeavyChain_CDR
  source 1..54: mol_type = other RNA
cacaagtaccacgacatcgtcatggtcgtccccatcgccggctggttcgacccc

SEQ ID NO: 20917 - RNA, 27 nt, synthetic construct
  misc_feature 1..27: note = derived and/or modified sequence opt2 from anti-HIV_PGT141_PGT142_PGT143_PGT144_LightChain_CDR
  source 1..27: mol_type = other RNA
atgcagggcctcaaccgcccctggacc

SEQ ID NO: 20918 - RNA, 96 nt, synthetic construct
  misc_feature 1..96: note = derived and/or modified sequence opt2 from anti-HIV_PGT141_HeavyChain_CDR
  source 1..96: mol_type = other RNA
ggctccaagcaccgcctccgcgactacgtcctctacgacgactacggcctcatcaactaccaggagtggaacgactacctcgagttcctcgacgtc

SEQ ID NO: 20919 - RNA, 96 nt, synthetic construct
  misc_feature 1..96: note = derived and/or modified sequence opt2 from anti-HIV_PGT144_HeavyChain_CDR
  source 1..96: mol_type = other RNA
ggctccaagcaccgcctccgcgactacgtcctctacgacgactacggcctcatcaaccagcaggagtggaacgactacctcgagttcctcgacgtc

SEQ ID NO: 20920 - RNA, 27 nt, synthetic construct
  misc_feature 1..27: note = derived and/or modified sequence opt2 from anti-HIV_PGT145_LightChain_CDR
  source 1..27: mol_type = other RNA
atgcagggcctccactccccctggacc

SEQ ID NO: 20921 - RNA, 93 nt, synthetic construct
  misc_feature 1..93: note = derived and/or modified sequence opt2 from anti-HIV_PGT145_HeavyChain_CDR
  source 1..93: mol_type = other RNA
ggctccaagcaccgcctccgcgactacttcctctacaacgagtacggccccaactacgaggagtggggcgactacctcgccaccctcgacgtc

SEQ ID NO: 20922 - RNA, 21 nt, synthetic construct
  misc_feature 1..21: note = derived and/or modified sequence opt2 from anti-HIV_VRC-CH30_VRC-CH31_VRC-CH32_VRC-CH33_VRC-CH34_Light Chain _CDR
  source 1..21: mol_type = other RNA
tgccagcagtacgagaccttc

SEQ ID NO: 20923 - RNA, 45 nt, synthetic construct
  misc_feature 1..45: note = derived and/or modified sequence opt2 from anti-HIV_VRC-CH30_VRC-CH31_VRC-CH32_VRC-CH34_HeavyChain_CDR
  source 1..45: mol_type = other RNA
gcccgcgcccagaagcgcggccgctccgagtgggcctacgcccac

SEQ ID NO: 20924 - RNA, 45 nt, synthetic construct
  misc_feature 1..45: note = derived and/or modified sequence opt2 from anti-HIV_VRC-CH33_HeavyChain_CDR
  source 1..45: mol_type = other RNA
gcccgcgcccagaagcgcgcccgctccgagtgggcctacgcccac

SEQ ID NO: 20925 - RNA, 21 nt, synthetic construct
  misc_feature 1..21: note = derived and/or modified sequence opt2 from anti-HIV_VRC-PG04_LightChain_CDR
  source 1..21: mol_type = other RNA
tgccagcagctcgagttcttc

SEQ ID NO: 20926 - RNA, 48 nt, synthetic construct
  misc_feature 1..48: note = derived and/or modified sequence opt2 from anti-HIV_VRC-PG04_HeavyChain_CDR
  source 1..48: mol_type = other RNA
gcccgccagaagttctacaccggcggccagggctggtacttcgacctc

SEQ ID NO: 20927 - RNA, 21 nt, synthetic construct
  misc_feature 1..21: note = derived and/or modified sequence opt2 from anti-HIV_VRC-PG04b_LightChain_CDR
  source 1..21: mol_type = other RNA
tgccagcaggtcgagttcttc

SEQ ID NO: 20928 - RNA, 48 nt, synthetic construct
  misc_feature 1..48: note = derived and/or modified sequence opt2 from anti-HIV_VRC-PG04b_HeavyChain_CDR
  source 1..48: mol_type = other RNA
gcccgccagaagttcgagcgcggcggccagggctggtacttcgacctc

SEQ ID NO: 20929 - RNA, 21 nt, synthetic construct
  misc_feature 1..21: note = derived and/or modified sequence opt2 from anti-HIV_VRC03_LightChain_CDR
  source 1..21: mol_type = other RNA
tgccagcagttcgagttcttc

SEQ ID NO: 20930 - RNA, 48 nt, synthetic construct
  misc_feature 1..48: note = derived and/or modified sequence opt2 from anti-HIV_VRC03_HeavyChain_CDR
  source 1..48: mol_type = other RNA
gtccgccgcggctcctgcgactactgcggcgacttcccctggcagtac

SEQ ID NO: 20931 - RNA, 21 nt, synthetic construct
  misc_feature 1..21: note = derived and/or modified sequence opt2 from anti-HIV_1TJG_P-Chain
  source 1..21: mol_type = other RNA
gagctcgacaagtgggcctcc

SEQ ID NO: 20932 - RNA, 69 nt, synthetic construct
  misc_feature 1..69: note = derived and/or modified sequence opt2 from anti-HIV_2B1H_P-Chain
  source 1..69: mol_type = other RNA
aacaacaccaagaagtccatcaagatccgcccccgccaggccttctacgccaccaacggcatcatcggc

SEQ ID NO: 20933 - RNA, 69 nt, synthetic construct
  misc_feature 1..69: note = derived and/or modified sequence opt2 from anti-HIV_2B1A_P-Chain
  source 1..69: mol_type = other RNA
aacaacacccgcaagtccatccacctcggccccggccgcgccttctacgccaccggcgacatcatcggc

SEQ ID NO: 20934 - RNA, 57 nt, synthetic construct
  misc_feature 1..57: note = derived and/or modified sequence opt2 from anti-HIV_2B0S_P-Chain
  source 1..57: mol_type = other RNA
aagcgcaagcgcatccacatcggccccggccgcgccttctacaccaccaagaacgcc

SEQ ID NO: 20935 - RNA, 69 nt, synthetic construct
  misc_feature 1..69: note = derived and/or modified sequence opt2 from anti-HIV_3UJJ_P-Chain
  source 1..69: mol_type = other RNA
aacaacacccgcaagtccatccgcatcggccccggccaggccttctacgccaccggcgacatcatcggc

SEQ ID NO: 20936 - RNA, 69 nt, synthetic construct
  misc_feature 1..69: note = derived and/or modified sequence opt2 from anti-HIV_3UJI_P-Chain
  source 1..69: mol_type = other RNA
tacaacaagcgcaagcgcatccacatcggccccggccgcgccttctacaccaccaagaacatcatcggc

SEQ ID NO: 20937 - RNA, 75 nt, synthetic construct
  misc_feature 1..75: note = derived and/or modified sequence opt2 from anti-HIV_3MLZ_P-Chain
  source 1..75: mol_type = other RNA
tccaacaacacccgcaagggcatccacatcggccccggccgcgccttctacgccaccggccagatcaccggcgac

SEQ ID NO: 20938 - RNA, 60 nt, synthetic construct
  misc_feature 1..60: note = derived and/or modified sequence opt2 from anti-HIV_3MLV_Q-Chain
  source 1..60: mol_type = other RNA
aacaacacccgcaagcgcatccgcgtcggccccggccagaccgtctacgccaccaacgcc

SEQ ID NO: 20939 - RNA, 69 nt, synthetic construct
  misc_feature 1..69: note = derived and/or modified sequence opt2 from anti-HIV_3MLU_P-Chain
  source 1..69: mol_type = other RNA
aacaacacccgcaagtccatccgcatcggccccggccaggccttctacgccaccggcggcatcatcggc

SEQ ID NO: 20940 - RNA, 60 nt, synthetic construct
  misc_feature 1..60: note = derived and/or modified sequence opt2 from anti-HIV_3MLR_P-Chain
  source 1..60: mol_type = other RNA
aacaacaccaagaagggcatcgccatcggccccggccgcaccctctacgcccgcgagaag

SEQ ID NO: 20941 - RNA, 48 nt, synthetic construct
  misc_feature 1..48: note = derived and/or modified sequence opt2 from anti-HIV_4XCF_P-Chain
  source 1..48: mol_type = other RNA
aactggtgggacatcaccaactggctctggtacatcaagaagaagaag

SEQ ID NO: 20942 - RNA, 45 nt, synthetic construct
  misc_feature 1..45: note = derived and/or modified sequence opt2 from anti-HIV_4XBE_P-Chain
  source 1..45: mol_type = other RNA
aactggttcgacatcaccaactggctctggtacatcaagaagaag

SEQ ID NO: 20943 - RNA, 48 nt, synthetic construct
  misc_feature 1..48: note = derived and/or modified sequence opt2 from anti-HIV_4XAW_P-Chain
  source 1..48: mol_type = other RNA
aactggttcgacatcaccaactggctctggtacatcaagaagaagaag

SEQ ID NO: 20944 - RNA, 45 nt, synthetic construct
  misc_feature 1..45: note = derived and/or modified sequence opt2 from anti-HIV_2QSC_P-Chain
  source 1..45: mol_type = other RNA
cgcaagcgcatccacatcggccccggccgcgccttctacaccacc

SEQ ID NO: 20945 - RNA, 60 nt, synthetic construct
  misc_feature 1..60: note = derived and/or modified sequence opt2 from anti-HIV_3MLS_S-Chain
  source 1..60: mol_type = other RNA
gcctgccaggccttctacgcctcctccccccgcaagtccatccacatcggcgcctgcgcc

SEQ ID NO: 20946 - RNA, 42 nt, synthetic construct
  misc_feature 1..42: note = derived and/or modified sequence opt2 from anti-HIV_3GO1_P-Chain
  source 1..42: mol_type = other RNA
cgcaagcgcatccacatcggccccggccgcgccttctacacc

SEQ ID NO: 20947 - RNA, 42 nt, synthetic construct
  misc_feature 1..42: note = derived and/or modified sequence opt2 from anti-HIV_4M1D_Q-Chain
  source 1..42: mol_type = other RNA
tgccgcatccacatcggccccggccgcgccttctacacctgc

SEQ ID NO: 20948 - RNA, 39 nt, synthetic construct
  misc_feature 1..39: note = derived and/or modified sequence opt2 from anti-HIV_3C2A_Q-Chain
  source 1..39: mol_type = other RNA
aagtccatccacctcggccccggccgcgccttctacgcc

SEQ ID NO: 20949 - RNA, 12 nt, synthetic construct
  misc_feature 1..12: note = derived and/or modified sequence opt2 from anti-HIV_CDR
  source 1..12: mol_type = other RNA
cagtccaagacc

SEQ ID NO: 20950 - RNA, 12 nt, synthetic construct
  misc_feature 1..12: note = derived and/or modified sequence opt2 from anti-HIV_CDR
  source 1..12: mol_type = other RNA
gacctcatcgac

SEQ ID NO: 20951 - RNA, 15 nt, synthetic construct
  misc_feature 1..15: note = derived and/or modified sequence opt2 from anti-HIV_CDR
  source 1..15: mol_type = other RNA
gaccactactggtcc

SEQ ID NO: 20952 - RNA, 15 nt, synthetic construct
  misc_feature 1..15: note = derived and/or modified sequence opt2 from anti-HIV_CDR
  source 1..15: mol_type = other RNA
ggccgcttctggtcc

SEQ ID NO: 20953 - RNA, 15 nt, synthetic construct
  misc_feature 1..15: note = derived and/or modified sequence opt2 from anti-HIV_CDR
  source 1..15: mol_type = other RNA
aactactactggacc

SEQ ID NO: 20954 - RNA, 15 nt, synthetic construct
  misc_feature 1..15: note = derived and/or modified sequence opt2 from anti-HIV_CDR
  source 1..15: mol_type = other RNA
gacgcctactggtcc

SEQ ID NO: 20955 - RNA, 15 nt, synthetic construct
  misc_feature 1..15: note = derived and/or modified sequence opt2 from anti-HIV_CDR
  source 1..15: mol_type = other RNA
gactcctactggtcc

SEQ ID NO: 20956 - RNA, 15 nt, synthetic construct
  misc_feature 1..15: note = derived and/or modified sequence opt2 from anti-HIV_CDR
  source 1..15: mol_type = other RNA
gacaactactggtcc

SEQ ID NO: 20957 - RNA, 15 nt, synthetic construct
  misc_feature 1..15: note = derived and/or modified sequence opt2 from anti-HIV_CDR
  source 1..15: mol_type = other RNA
aactcctactggacc

SEQ ID NO: 20958 - RNA, 15 nt, synthetic construct
  misc_feature 1..15: note = derived and/or modified sequence opt2 from anti-HIV_CDR
  source 1..15: mol_type = other RNA
tcctactactggtcc

SEQ ID NO: 20959 - RNA, 15 nt, synthetic construct
  misc_feature 1..15: note = derived and/or modified sequence opt2 from anti-HIV_CDR
  source 1..15: mol_type = other RNA
tccttcggcatgcac

SEQ ID NO: 20960 - RNA, 15 nt, synthetic construct
  misc_feature 1..15: note = derived and/or modified sequence opt2 from anti-HIV_CDR
  source 1..15: mol_type = other RNA
gccgccttccagtgg

SEQ ID NO: 20961 - RNA, 15 nt, synthetic construct
  misc_feature 1..15: note = derived and/or modified sequence opt2 from anti-HIV_CDR
  source 1..15: mol_type = other RNA
cagcagctccgcacc

SEQ ID NO: 20962 - RNA, 15 nt, synthetic construct
  misc_feature 1..15: note = derived and/or modified sequence opt2 from anti-HIV_CDR
  source 1..15: mol_type = other RNA
cagcagtacgactcc

SEQ ID NO: 20963 - RNA, 15 nt, synthetic construct
  misc_feature 1..15: note = derived and/or modified sequence opt2 from anti-HIV_CDR
  source 1..15: mol_type = other RNA
cagcagctcgccacc

SEQ ID NO: 20964 - RNA, 15 nt, synthetic construct
  misc_feature 1..15: note = derived and/or modified sequence opt2 from anti-HIV_CDR
  source 1..15: mol_type = other RNA
gagtccttccagtgg

SEQ ID NO: 20965 - RNA, 15 nt, synthetic construct
  misc_feature 1..15: note = derived and/or modified sequence opt2 from anti-HIV_CDR
  source 1..15: mol_type = other RNA
gaggtctacgagttc

SEQ ID NO: 20966 - RNA, 15 nt, synthetic construct
  misc_feature 1..15: note = derived and/or modified sequence opt2 from anti-HIV_CDR
  source 1..15: mol_type = other RNA
gcctccctcgagttc

SEQ ID NO: 20967 - RNA, 15 nt, synthetic construct
  misc_feature 1..15: note = derived and/or modified sequence opt2 from anti-HIV_CDR
  source 1..15: mol_type = other RNA
tccgtctacgagttc

SEQ ID NO: 20968 - RNA, 15 nt, synthetic construct
  misc_feature 1..15: note = derived and/or modified sequence opt2 from anti-HIV_CDR
  source 1..15: mol_type = other RNA
gccgccctcgagttc

SEQ ID NO: 20969 - RNA, 15 nt, synthetic construct
  misc_feature 1..15: note = derived and/or modified sequence opt2 from anti-HIV_CDR
  source 1..15: mol_type = other RNA
gccgtcgtcgagttc

SEQ ID NO: 20970 - RNA, 15 nt, synthetic construct
  misc_feature 1..15: note = derived and/or modified sequence opt2 from anti-HIV_CDR
  source 1..15: mol_type = other RNA
cagctcttcgagttc

SEQ ID NO: 20971 - RNA, 15 nt, synthetic construct
  misc_feature 1..15: note = derived and/or modified sequence opt2 from anti-HIV_CDR
  source 1..15: mol_type = other RNA
gccgtcttccagtgg

SEQ ID NO: 20972 - RNA, 15 nt, synthetic construct
  misc_feature 1..15: note = derived and/or modified sequence opt2 from anti-HIV_CDR
  source 1..15: mol_type = other RNA
gccgtcctcgagttc

SEQ ID NO: 20973 - RNA, 15 nt, synthetic construct
  misc_feature 1..15: note = derived and/or modified sequence opt2 from anti-HIV_CDR
  source 1..15: mol_type = other RNA
aacggcttcgacgtc

SEQ ID NO: 20974 - RNA, 15 nt, synthetic construct
  misc_feature 1..15: note = derived and/or modified sequence opt2 from anti-HIV_CDR
  source 1..15: mol_type = other RNA
cagcagtacgagttc

SEQ ID NO: 20975 - RNA, 15 nt, synthetic construct
  misc_feature 1..15: note = derived and/or modified sequence opt2 from anti-HIV_CDR
  source 1..15: mol_type = other RNA
cagcactacgagttc

SEQ ID NO: 20976 - RNA, 15 nt, synthetic construct
  misc_feature 1..15: note = derived and/or modified sequence opt2 from anti-HIV_CDR
  source 1..15: mol_type = other RNA
caggtctacgaggtc

SEQ ID NO: 20977 - RNA, 15 nt, synthetic construct
  misc_feature 1..15: note = derived and/or modified sequence opt2 from anti-HIV_CDR
  source 1..15: mol_type = other RNA
caggtctacgagttc

SEQ ID NO: 20978 - RNA, 15 nt, synthetic construct
  misc_feature 1..15: note = derived and/or modified sequence opt2 from anti-HIV_CDR
  source 1..15: mol_type = other RNA
ttctccaaggagtcc

SEQ ID NO: 20979 - RNA, 15 nt, synthetic construct
  misc_feature 1..15: note = derived and/or modified sequence opt2 from anti-HIV_CDR
  source 1..15: mol_type = other RNA
ctcaagctctcctcc

SEQ ID NO: 20980 - RNA, 15 nt, synthetic construct
  misc_feature 1..15: note = derived and/or modified sequence opt2 from anti-HIV_CDR
  source 1..15: mol_type = other RNA
tacaaggtctcctcc

SEQ ID NO: 20981 - RNA, 15 nt, synthetic construct
  misc_feature 1..15: note = derived and/or modified sequence opt2 from anti-HIV_CDR
  source 1..15: mol_type = other RNA
cccccccaggagtcc

SEQ ID NO: 20982 - RNA, 15 nt, synthetic construct
  misc_feature 1..15: note = derived and/or modified sequence opt2 from anti-HIV_CDR
  source 1..15: mol_type = other RNA
accgcccgcgactac

SEQ ID NO: 20983 - RNA, 15 nt, synthetic construct
  misc_feature 1..15: note = derived and/or modified sequence opt2 from anti-HIV_CDR
  source 1..15: mol_type = other RNA
atgcagtccatccag

SEQ ID NO: 20984 - RNA, 15 nt, synthetic construct
  misc_feature 1..15: note = derived and/or modified sequence opt2 from anti-HIV_CDR
  source 1..15: mol_type = other RNA
caccagctcgacacc

SEQ ID NO: 20985 - RNA, 15 nt, synthetic construct
  misc_feature 1..15: note = derived and/or modified sequence opt2 from anti-HIV_CDR
  source 1..15: mol_type = other RNA
caccagctcgactcc

SEQ ID NO: 20986 - RNA, 15 nt, synthetic construct
  misc_feature 1..15: note = derived and/or modified sequence opt2 from anti-HIV_CDR
  source 1..15: mol_type = other RNA
cagcagctcggcacc

SEQ ID NO: 20987 - RNA, 15 nt, synthetic construct
  misc_feature 1..15: note = derived and/or modified sequence opt2 from anti-HIV_CDR
  source 1..15: mol_type = other RNA
cagaaggccaccacc

SEQ ID NO: 20988 - RNA, 15 nt, synthetic construct
  misc_feature 1..15: note = derived and/or modified sequence opt2 from anti-HIV_CDR
  source 1..15: mol_type = other RNA
ctcttcgccggcacc

SEQ ID NO: 20989 - RNA, 18 nt, synthetic construct
  misc_feature 1..18: note = derived and/or modified sequence opt2 from anti-HIV_CDR
  source 1..18: mol_type = other RNA
gtccgcggctcctccccc

SEQ ID NO: 20990 - RNA, 18 nt, synthetic construct
  misc_feature 1..18: note = derived and/or modified sequence opt2 from anti-HIV_CDR
  source 1..18: mol_type = other RNA
ggcctcctcttcgtcgtc

SEQ ID NO: 20991 - RNA, 18 nt, synthetic construct
  misc_feature 1..18: note = derived and/or modified sequence opt2 from anti-HIV_CDR
  source 1..18: mol_type = other RNA
atggactggacctggtcc

SEQ ID NO: 20992 - RNA, 18 nt, synthetic construct
  misc_feature 1..18: note = derived and/or modified sequence opt2 from anti-HIV_CDR
  source 1..18: mol_type = other RNA
atggactggacctggcgc

SEQ ID NO: 20993 - RNA, 18 nt, synthetic construct
  misc_feature 1..18: note = derived and/or modified sequence opt2 from anti-HIV_CDR
  source 1..18: mol_type = other RNA
atgaagcacctctggttc

SEQ ID NO: 20994 - RNA, 18 nt, synthetic construct
  misc_feature 1..18: note = derived and/or modified sequence opt2 from anti-HIV_CDR
  source 1..18: mol_type = other RNA
atggactggatctggcgc

SEQ ID NO: 20995 - RNA, 18 nt, synthetic construct
  misc_feature 1..18: note = derived and/or modified sequence opt2 from anti-HIV_CDR
  source 1..18: mol_type = other RNA
atggactggacctggacc

SEQ ID NO: 20996 - RNA, 18 nt, synthetic construct
  misc_feature 1..18: note = derived and/or modified sequence opt2 from anti-HIV_CDR
  source 1..18: mol_type = other RNA
atgaagcacctcttcctc

SEQ ID NO: 20997 - RNA, 18 nt, synthetic construct
  misc_feature 1..18: note = derived and/or modified sequence opt2 from anti-HIV_CDR
  source 1..18: mol_type = other RNA
cagctcctccagtccaac

SEQ ID NO: 20998 - RNA, 18 nt, synthetic construct
  misc_feature 1..18: note = derived and/or modified sequence opt2 from anti-HIV_CDR
  source 1..18: mol_type = other RNA
ggcggctcccccgagcac

SEQ ID NO: 20999 - RNA, 18 nt, synthetic construct
  misc_feature 1..18: note = derived and/or modified sequence opt2 from anti-HIV_CDR
  source 1..18: mol_type = other RNA
ctcgagggcaccgactac

SEQ ID NO: 21000 - RNA, 18 nt, synthetic construct
  misc_feature 1..18: note = derived and/or modified sequence opt2 from anti-HIV_CDR
  source 1..18: mol_type = other RNA
cagcagtacccctccacc

SEQ ID NO: 21001 - RNA, 21 nt, synthetic construct
  misc_feature 1..21: note = derived and/or modified sequence opt2 from anti-HIV_CDR
  source 1..21: mol_type = other RNA
aacaaccacgaccgcccctcc

SEQ ID NO: 21002 - RNA, 21 nt, synthetic construct
  misc_feature 1..21: note = derived and/or modified sequence opt2 from anti-HIV_CDR
  source 1..21: mol_type = other RNA
aacaaccaggaccgccccgcc

SEQ ID NO: 21003 - RNA, 21 nt, synthetic construct
  misc_feature 1..21: note = derived and/or modified sequence opt2 from anti-HIV_CDR
  source 1..21: mol_type = other RNA
aacaacaacgaccgcccctcc

SEQ ID NO: 21004 - RNA, 21 nt, synthetic construct
  misc_feature 1..21: note = derived and/or modified sequence opt2 from anti-HIV_CDR
  source 1..21: mol_type = other RNA
aacaaccaggaccgcccctcc

SEQ ID NO: 21005 - RNA, 21 nt, synthetic construct
  misc_feature 1..21: note = derived and/or modified sequence opt2 from anti-HIV_CDR
  source 1..21: mol_type = other RNA
gacgactccgaccgcccctcc

SEQ ID NO: 21006 - RNA, 21 nt, synthetic construct
  misc_feature 1..21: note = derived and/or modified sequence opt2 from anti-HIV_CDR
  source 1..21: mol_type = other RNA
tgggcctccacccgccacacc

SEQ ID NO: 21007 - RNA, 21 nt, synthetic construct
  misc_feature 1..21: note = derived and/or modified sequence opt2 from anti-HIV_CDR
  source 1..21: mol_type = other RNA
ggcgccaccgcccgcgacttc

SEQ ID NO: 21008 - RNA, 21 nt, synthetic construct
  misc_feature 1..21: note = derived and/or modified sequence opt2 from anti-HIV_CDR
  source 1..21: mol_type = other RNA
gcctccatcaagctcgccctc

SEQ ID NO: 21009 - RNA, 21 nt, synthetic construct
  misc_feature 1..21: note = derived and/or modified sequence opt2 from anti-HIV_CDR
  source 1..21: mol_type = other RNA
cagcagtacggccgctccccc

SEQ ID NO: 21010 - RNA, 21 nt, synthetic construct
  misc_feature 1..21: note = derived and/or modified sequence opt2 from anti-HIV_CDR
  source 1..21: mol_type = other RNA
cagcagtactacatctccccc

SEQ ID NO: 21011 - RNA, 21 nt, synthetic construct
  misc_feature 1..21: note = derived and/or modified sequence opt2 from anti-HIV_CDR
  source 1..21: mol_type = other RNA
cagcagtcccactccccctcc

SEQ ID NO: 21012 - RNA, 21 nt, synthetic construct
  misc_feature 1..21: note = derived and/or modified sequence opt2 from anti-HIV_CDR
  source 1..21: mol_type = other RNA
ggccgctgcgcccgccgctgg

SEQ ID NO: 21013 - RNA, 21 nt, synthetic construct
  misc_feature 1..21: note = derived and/or modified sequence opt2 from anti-HIV_CDR
  source 1..21: mol_type = other RNA
cgcttcctcttcgtcgtcgcc

SEQ ID NO: 21014 - RNA, 21 nt, synthetic construct
  misc_feature 1..21: note = derived and/or modified sequence opt2 from anti-HIV_CDR
  source 1..21: mol_type = other RNA
atgtccgtctccttcctcatc

SEQ ID NO: 21015 - RNA, 21 nt, synthetic construct
  misc_feature 1..21: note = derived and/or modified sequence opt2 from anti-HIV_CDR
  source 1..21: mol_type = other RNA
ggctcctccaaccgctgcccc

SEQ ID NO: 21016 - RNA, 21 nt, synthetic construct
  misc_feature 1..21: note = derived and/or modified sequence opt2 from anti-HIV_CDR
  source 1..21: mol_type = other RNA
atgaagcacctctggttcttc

SEQ ID NO: 21017 - RNA, 21 nt, synthetic construct
  misc_feature 1..21: note = derived and/or modified sequence opt2 from anti-HIV_CDR
  source 1..21: mol_type = other RNA
gcctcctgggacttcgacttc

SEQ ID NO: 21018 - RNA, 21 nt, synthetic construct
  misc_feature 1..21: note = derived and/or modified sequence opt2 from anti-HIV_CDR
  source 1..21: mol_type = other RNA
gagatcggcgtcgccgagcac

SEQ ID NO: 21019 - RNA, 21 nt, synthetic construct
  misc_feature 1..21: note = derived and/or modified sequence opt2 from anti-HIV_CDR
  source 1..21: mol_type = other RNA
cagaagtacgacaccgccccc

SEQ ID NO: 21020 - RNA, 21 nt, synthetic construct
  misc_feature 1..21: note = derived and/or modified sequence opt2 from anti-HIV_CDR
  source 1..21: mol_type = other RNA
cagcagtcctcctccaccccc

SEQ ID NO: 21021 - RNA, 21 nt, synthetic construct
  misc_feature 1..21: note = derived and/or modified sequence opt2 from anti-HIV_CDR
  source 1..21: mol_type = other RNA
cagcagtccgccggcaccccc

SEQ ID NO: 21022 - RNA, 21 nt, synthetic construct
  misc_feature 1..21: note = derived and/or modified sequence opt2 from anti-HIV_CDR
  source 1..21: mol_type = other RNA
cagcagtcctcctccaagccc

SEQ ID NO: 21023 - RNA, 21 nt, synthetic construct
  misc_feature 1..21: note = derived and/or modified sequence opt2 from anti-HIV_CDR
  source 1..21: mol_type = other RNA
caggagtacaacacctacacc

SEQ ID NO: 21024 - RNA, 21 nt, synthetic construct
  misc_feature 1..21: note = derived and/or modified sequence opt2 from anti-HIV_CDR
  source 1..21: mol_type = other RNA
caggagtacaacaactacaac

SEQ ID NO: 21025 - RNA, 21 nt, synthetic construct
  misc_feature 1..21: note = derived and/or modified sequence opt2 from anti-HIV_CDR
  source 1..21: mol_type = other RNA
cactacgacgccctcgactac

SEQ ID NO: 21026 - RNA, 24 nt, synthetic construct
  misc_feature 1..24: note = derived and/or modified sequence opt2 from anti-HIV_CDR
  source 1..24: mol_type = other RNA
gccatcttcaagggcgtccagtgc

SEQ ID NO: 21027 - RNA, 24 nt, synthetic construct
  misc_feature 1..24: note = derived and/or modified sequence opt2 from anti-HIV_CDR
  source 1..24: mol_type = other RNA
ggccccctcggcgactacgacttc

SEQ ID NO: 21028 - RNA, 24 nt, synthetic construct
  misc_feature 1..24: note = derived and/or modified sequence opt2 from anti-HIV_CDR
  source 1..24: mol_type = other RNA
cagcagtacggctcctccctccgc

SEQ ID NO: 21029 - RNA, 24 nt, synthetic construct
  misc_feature 1..24: note = derived and/or modified sequence opt2 from anti-HIV_CDR
  source 1..24: mol_type = other RNA
cagcagtactcccactaccgcacc

SEQ ID NO: 21030 - RNA, 24 nt, synthetic construct
  misc_feature 1..24: note = derived and/or modified sequence opt2 from anti-HIV_CDR
  source 1..24: mol_type = other RNA
cagtactacggcatgtccgtcacc

SEQ ID NO: 21031 - RNA, 24 nt, synthetic construct
  misc_feature 1..24: note = derived and/or modified sequence opt2 from anti-HIV_CDR
  source 1..24: mol_type = other RNA
cagcagtacgagaactggctcacc

SEQ ID NO: 21032 - RNA, 24 nt, synthetic construct
  misc_feature 1..24: note = derived and/or modified sequence opt2 from anti-HIV_CDR
  source 1..24: mol_type = other RNA
tccggcgtccactacatggacgtc

SEQ ID NO: 21033 - RNA, 24 nt, synthetic construct
  misc_feature 1..24: note = derived and/or modified sequence opt2 from anti-HIV_CDR
  source 1..24: mol_type = other RNA
cagcagtactccggccccctcacc

SEQ ID NO: 21034 - RNA, 24 nt, synthetic construct
  misc_feature 1..24: note = derived and/or modified sequence opt2 from anti-HIV_CDR
  source 1..24: mol_type = other RNA
cagcagtactacaccgtcccctcc

SEQ ID NO: 21035 - RNA, 24 nt, synthetic construct
  misc_feature 1..24: note = derived and/or modified sequence opt2 from anti-HIV_CDR
  source 1..24: mol_type = other RNA
cagcagtacggctcctccatcacc

SEQ ID NO: 21036 - RNA, 24 nt, synthetic construct
  misc_feature 1..24: note = derived and/or modified sequence opt2 from anti-HIV_CDR
  source 1..24: mol_type = other RNA
caccagtacaacaagtgggacacc

SEQ ID NO: 21037 - RNA, 24 nt, synthetic construct
  misc_feature 1..24: note = derived and/or modified sequence opt2 from anti-HIV_CDR
  source 1..24: mol_type = other RNA
cagcagtcctacaccacccccctc

SEQ ID NO: 21038 - RNA, 24 nt, synthetic construct
  misc_feature 1..24: note = derived and/or modified sequence opt2 from anti-HIV_CDR
  source 1..24: mol_type = other RNA
cagcgctgggagaccatcgactac

SEQ ID NO: 21039 - RNA, 24 nt, synthetic construct
  misc_feature 1..24: note = derived and/or modified sequence opt2 from anti-HIV_CDR
  source 1..24: mol_type = other RNA
tgctcctacgccggctcctacacc

SEQ ID NO: 21040 - RNA, 24 nt, synthetic construct
  misc_feature 1..24: note = derived and/or modified sequence opt2 from anti-HIV_CDR
  source 1..24: mol_type = other RNA
cagcagtacgacaacctccccacc

SEQ ID NO: 21041 - RNA, 24 nt, synthetic construct
  misc_feature 1..24: note = derived and/or modified sequence opt2 from anti-HIV_CDR
  source 1..24: mol_type = other RNA
cagcagtgcaccctccccctcacc

SEQ ID NO: 21042 - RNA, 24 nt, synthetic construct
  misc_feature 1..24: note = derived and/or modified sequence opt2 from anti-HIV_CDR
  source 1..24: mol_type = other RNA
cagcagtcctactcctccgtcacc

SEQ ID NO: 21043 - RNA, 24 nt, synthetic construct
  misc_feature 1..24: note = derived and/or modified sequence opt2 from anti-HIV_CDR
  source 1..24: mol_type = other RNA
cagcagtcccacacctccgtcacc

SEQ ID NO: 21044 - RNA, 24 nt, synthetic construct
  misc_feature 1..24: note = derived and/or modified sequence opt2 from anti-HIV_CDR
  source 1..24: mol_type = other RNA
cagcagacctacgcctccgtcacc

SEQ ID NO: 21045 - RNA, 24 nt, synthetic construct
  misc_feature 1..24: note = derived and/or modified sequence opt2 from anti-HIV_CDR
  source 1..24: mol_type = other RNA
cagcagtacaactccgactacacc

SEQ ID NO: 21046 - RNA, 24 nt, synthetic construct
  misc_feature 1..24: note = derived and/or modified sequence opt2 from anti-HIV_CDR
  source 1..24: mol_type = other RNA
cacctctacgtctcccgccccgtc

SEQ ID NO: 21047 - RNA, 24 nt, synthetic construct
  misc_feature 1..24: note = derived and/or modified sequence opt2 from anti-HIV_CDR
  source 1..24: mol_type = other RNA
cagcagtacggccgctcccccctc

SEQ ID NO: 21048 - RNA, 24 nt, synthetic construct
  misc_feature 1..24: note = derived and/or modified sequence opt2 from anti-HIV_CDR
  source 1..24: mol_type = other RNA
cagcagtacggctcctcccccctc

SEQ ID NO: 21049 - RNA, 24 nt, synthetic construct
  misc_feature 1..24: note = derived and/or modified sequence opt2 from anti-HIV_CDR
  source 1..24: mol_type = other RNA
cagcagtacaacgactggcccgcc

SEQ ID NO: 21050 - RNA, 24 nt, synthetic construct
  misc_feature 1..24: note = derived and/or modified sequence opt2 from anti-HIV_CDR
  source 1..24: mol_type = other RNA
caccagtacggctcctcccagcgc

SEQ ID NO: 21051 - RNA, 24 nt, synthetic construct
  misc_feature 1..24: note = derived and/or modified sequence opt2 from anti-HIV_CDR
  source 1..24: mol_type = other RNA
cagcagacctactcctccgtcacc

SEQ ID NO: 21052 - RNA, 24 nt, synthetic construct
  misc_feature 1..24: note = derived and/or modified sequence opt2 from anti-HIV_CDR
  source 1..24: mol_type = other RNA
cagcagacctaccgctccgtcacc

SEQ ID NO: 21053 - RNA, 24 nt, synthetic construct
  misc_feature 1..24: note = derived and/or modified sequence opt2 from anti-HIV_CDR
  source 1..24: mol_type = other RNA
cagcagtacggctcctcctggacc

SEQ ID NO: 21054 - RNA, 24 nt, synthetic construct
  misc_feature 1..24: note = derived and/or modified sequence opt2 from anti-HIV_CDR
  source 1..24: mol_type = other RNA
tcctcctacgccggcatcaacaac

SEQ ID NO: 21055 - RNA, 24 nt, synthetic construct
  misc_feature 1..24: note = derived and/or modified sequence opt2 from anti-HIV_CDR
  source 1..24: mol_type = other RNA
cagaagtacggctcctccctcacc

SEQ ID NO: 21056 - RNA, 24 nt, synthetic construct
  misc_feature 1..24: note = derived and/or modified sequence opt2 from anti-HIV_CDR
  source 1..24: mol_type = other RNA
atgcaggccctcgagaccctcggc

SEQ ID NO: 21057 - RNA, 24 nt, synthetic construct
  misc_feature 1..24: note = derived and/or modified sequence opt2 from anti-HIV_CDR
  source 1..24: mol_type = other RNA
cagcagtacgccggctccctcacc

SEQ ID NO: 21058 - RNA, 24 nt, synthetic construct
  misc_feature 1..24: note = derived and/or modified sequence opt2 from anti-HIV_CDR
  source 1..24: mol_type = other RNA
cgcaactggggcaacttcgaccac

SEQ ID NO: 21059 - RNA, 27 nt, synthetic construct
  misc_feature 1..27: note = derived and/or modified sequence opt2 from anti-HIV_CDR
  source 1..27: mol_type = other RNA
cagcagcactacaccaccccctggacc

SEQ ID NO: 21060 - RNA, 27 nt, synthetic construct
  misc_feature 1..27: note = derived and/or modified sequence opt2 from anti-HIV_CDR
  source 1..27: mol_type = other RNA
cagcagtccttcgccgtcccctacacc

SEQ ID NO: 21061 - RNA, 27 nt, synthetic construct
  misc_feature 1..27: note = derived and/or modified sequence opt2 from anti-HIV_CDR
  source 1..27: mol_type = other RNA
cagcagtacaagtcctactccggcacc

SEQ ID NO: 21062 - RNA, 27 nt, synthetic construct
  misc_feature 1..27: note = derived and/or modified sequence opt2 from anti-HIV_CDR
  source 1..27: mol_type = other RNA
caccagtacgcctactccccccgcacc

SEQ ID NO: 21063 - RNA, 27 nt, synthetic construct
  misc_feature 1..27: note = derived and/or modified sequence opt2 from anti-HIV_CDR
  source 1..27: mol_type = other RNA
cagcagtacaactccttcccccccacc

SEQ ID NO: 21064 - RNA, 27 nt, synthetic construct
  misc_feature 1..27: note = derived and/or modified sequence opt2 from anti-HIV_CDR
  source 1..27: mol_type = other RNA
cagcagacctactccaacccccgcatg

SEQ ID NO: 21065 - RNA, 27 nt, synthetic construct
  misc_feature 1..27: note = derived and/or modified sequence opt2 from anti-HIV_CDR
  source 1..27: mol_type = other RNA
cagcagtacgaggaccccccctggacc

SEQ ID NO: 21066 - RNA, 27 nt, synthetic construct
  misc_feature 1..27: note = derived and/or modified sequence opt2 from anti-HIV_CDR
  source 1..27: mol_type = other RNA
caccagtacttcaacaccccccgcacc

SEQ ID NO: 21067 - RNA, 27 nt, synthetic construct
  misc_feature 1..27: note = derived and/or modified sequence opt2 from anti-HIV_CDR
  source 1..27: mol_type = other RNA
caccagtacttctccaccccccgcacc

SEQ ID NO: 21068 - RNA, 27 nt, synthetic construct
  misc_feature 1..27: note = derived and/or modified sequence opt2 from anti-HIV_CDR
  source 1..27: mol_type = other RNA
cagcaccgctccaactggccctggacc

SEQ ID NO: 21069 - RNA, 27 nt, synthetic construct
  misc_feature 1..27: note = derived and/or modified sequence opt2 from anti-HIV_CDR
  source 1..27: mol_type = other RNA
cgcggccgccgccagatcggcgactac

SEQ ID NO: 21070 - RNA, 27 nt, synthetic construct
  misc_feature 1..27: note = derived and/or modified sequence opt2 from anti-HIV_CDR
  source 1..27: mol_type = other RNA
cagcagtacggcctctccccctggacc

SEQ ID NO: 21071 - RNA, 27 nt, synthetic construct
  misc_feature 1..27: note = derived and/or modified sequence opt2 from anti-HIV_CDR
  source 1..27: mol_type = other RNA
cagcagacctacacctcccccatcacc

SEQ ID NO: 21072 - RNA, 27 nt, synthetic construct
  misc_feature 1..27: note = derived and/or modified sequence opt2 from anti-HIV_CDR
  source 1..27: mol_type = other RNA
cagcagtacggctcctccccccccacc

SEQ ID NO: 21073 - RNA, 27 nt, synthetic construct
  misc_feature 1..27: note = derived and/or modified sequence opt2 from anti-HIV_CDR
  source 1..27: mol_type = other RNA
cagcagtacggcacctcctcctgcacc

SEQ ID NO: 21074 - RNA, 27 nt, synthetic construct
  misc_feature 1..27: note = derived and/or modified sequence opt2 from anti-HIV_CDR
  source 1..27: mol_type = other RNA
cagcagtacgacgacgcccccatcacc

SEQ ID NO: 21075 - RNA, 27 nt, synthetic construct
  misc_feature 1..27: note = derived and/or modified sequence opt2 from anti-HIV_CDR
  source 1..27: mol_type = other RNA
ggccccctcctccgctacctcgactcc

SEQ ID NO: 21076 - RNA, 27 nt, synthetic construct
  misc_feature 1..27: note = derived and/or modified sequence opt2 from anti-HIV_CDR
  source 1..27: mol_type = other RNA
tgcctcaagaagacctcctcctacgtc

SEQ ID NO: 21077 - RNA, 27 nt, synthetic construct
  misc_feature 1..27: note = derived and/or modified sequence opt2 from anti-HIV_CDR
  source 1..27: mol_type = other RNA
cagcagtacaaccactggccccagacc

SEQ ID NO: 21078 - RNA, 27 nt, synthetic construct
  misc_feature 1..27: note = derived and/or modified sequence opt2 from anti-HIV_CDR
  source 1..27: mol_type = other RNA
cagcagtactccaacctcccctacacc

SEQ ID NO: 21079 - RNA, 27 nt, synthetic construct
  misc_feature 1..27: note = derived and/or modified sequence opt2 from anti-HIV_CDR
  source 1..27: mol_type = other RNA
cagcagtacgacacctaccccggcacc

SEQ ID NO: 21080 - RNA, 27 nt, synthetic construct
  misc_feature 1..27: note = derived and/or modified sequence opt2 from anti-HIV_CDR
  source 1..27: mol_type = other RNA
caggagtactcctccaccccctacaac

SEQ ID NO: 21081 - RNA, 27 nt, synthetic construct
  misc_feature 1..27: note = derived and/or modified sequence opt2 from anti-HIV_CDR
  source 1..27: mol_type = other RNA
ggcgcctgggacgacaccctctacgtc

SEQ ID NO: 21082 - RNA, 27 nt, synthetic construct
  misc_feature 1..27: note = derived and/or modified sequence opt2 from anti-HIV_CDR
  source 1..27: mol_type = other RNA
gccgcctgggacgacaccctctacgtc

SEQ ID NO: 21083 - RNA, 27 nt, synthetic construct
  misc_feature 1..27: note = derived and/or modified sequence opt2 from anti-HIV_CDR
  source 1..27: mol_type = other RNA
cagcagtactactccgactccatcacc

SEQ ID NO: 21084 - RNA, 27 nt, synthetic construct
  misc_feature 1..27: note = derived and/or modified sequence opt2 from anti-HIV_CDR
  source 1..27: mol_type = other RNA
cagcagtacggccgctccccctacacc

SEQ ID NO: 21085 - RNA, 27 nt, synthetic construct
  misc_feature 1..27: note = derived and/or modified sequence opt2 from anti-HIV_CDR
  source 1..27: mol_type = other RNA
cagcagtacaccaactacccctggacc

SEQ ID NO: 21086 - RNA, 27 nt, synthetic construct
  misc_feature 1..27: note = derived and/or modified sequence opt2 from anti-HIV_CDR
  source 1..27: mol_type = other RNA
cagcagcgccacaactggcccatctcc

SEQ ID NO: 21087 - RNA, 27 nt, synthetic construct
  misc_feature 1..27: note = derived and/or modified sequence opt2 from anti-HIV_CDR
  source 1..27: mol_type = other RNA
cagcagtaccacaactggccccgcacc

SEQ ID NO: 21088 - RNA, 27 nt, synthetic construct
  misc_feature 1..27: note = derived and/or modified sequence opt2 from anti-HIV_CDR
  source 1..27: mol_type = other RNA
cagcagcgctccacctggccccccacc

SEQ ID NO: 21089 - RNA, 27 nt, synthetic construct
  misc_feature 1..27: note = derived and/or modified sequence opt2 from anti-HIV_CDR
  source 1..27: mol_type = other RNA
cagcagtacgactccttctcctggacc

SEQ ID NO: 21090 - RNA, 27 nt, synthetic construct
  misc_feature 1..27: note = derived and/or modified sequence opt2 from anti-HIV_CDR
  source 1..27: mol_type = other RNA
cagcagtacaacaacctccccgtcacc

SEQ ID NO: 21091 - RNA, 27 nt, synthetic construct
  misc_feature 1..27: note = derived and/or modified sequence opt2 from anti-HIV_CDR
  source 1..27: mol_type = other RNA
cagcagtacaaccgctactcctacacc

SEQ ID NO: 21092 - RNA, 27 nt, synthetic construct
  misc_feature 1..27: note = derived and/or modified sequence opt2 from anti-HIV_CDR
  source 1..27: mol_type = other RNA
caggagtactacatcctcccctgctcc

SEQ ID NO: 21093 - RNA, 27 nt, synthetic construct
  misc_feature 1..27: note = derived and/or modified sequence opt2 from anti-HIV_CDR
  source 1..27: mol_type = other RNA
cagcagtacgacaacctcctcgcccac

SEQ ID NO: 21094 - RNA, 27 nt, synthetic construct
  misc_feature 1..27: note = derived and/or modified sequence opt2 from anti-HIV_CDR
  source 1..27: mol_type = other RNA
caccagtgcgacaacctcatcgcccgc

SEQ ID NO: 21095 - RNA, 27 nt, synthetic construct
  misc_feature 1..27: note = derived and/or modified sequence opt2 from anti-HIV_CDR
  source 1..27: mol_type = other RNA
cagcagtccttctccaccctctggacc

SEQ ID NO: 21096 - RNA, 27 nt, synthetic construct
  misc_feature 1..27: note = derived and/or modified sequence opt2 from anti-HIV_CDR
  source 1..27: mol_type = other RNA
caccagtcctactccaccccccccacc

SEQ ID NO: 21097 - RNA, 27 nt, synthetic construct
  misc_feature 1..27: note = derived and/or modified sequence opt2 from anti-HIV_CDR
  source 1..27: mol_type = other RNA
cagcagggctactccaccccctggacc

SEQ ID NO: 21098 - RNA, 27 nt, synthetic construct
  misc_feature 1..27: note = derived and/or modified sequence opt2 from anti-HIV_CDR
  source 1..27: mol_type = other RNA
cagcagtactccaccaccccccgcacc

SEQ ID NO: 21099 - RNA, 27 nt, synthetic construct
  misc_feature 1..27: note = derived and/or modified sequence opt2 from anti-HIV_CDR
  source 1..27: mol_type = other RNA
cagctctacaactccgtcccccagacc

SEQ ID NO: 21100 - RNA, 27 nt, synthetic construct
  misc_feature 1..27: note = derived and/or modified sequence opt2 from anti-HIV_CDR
  source 1..27: mol_type = other RNA
cagcagcgcacctcctggccccagacc

SEQ ID NO: 21101 - RNA, 27 nt, synthetic construct
  misc_feature 1..27: note = derived and/or modified sequence opt2 from anti-HIV_CDR
  source 1..27: mol_type = other RNA
cagcagttcaacacctactcccagacc

SEQ ID NO: 21102 - RNA, 27 nt, synthetic construct
  misc_feature 1..27: note = derived and/or modified sequence opt2 from anti-HIV_CDR
  source 1..27: mol_type = other RNA
atgcagtccctccagacccccatcacc

SEQ ID NO: 21103 - RNA, 27 nt, synthetic construct
  misc_feature 1..27: note = derived and/or modified sequence opt2 from anti-HIV_CDR
  source 1..27: mol_type = other RNA
cagcagtacaactcctaccccctcacc

SEQ ID NO: 21104 - RNA, 27 nt, synthetic construct
  misc_feature 1..27: note = derived and/or modified sequence opt2 from anti-HIV_CDR
  source 1..27: mol_type = other RNA
cagcagtacaactcctactccggcacc

SEQ ID NO: 21105 - RNA, 27 nt, synthetic construct
  misc_feature 1..27: note = derived and/or modified sequence opt2 from anti-HIV_CDR
  source 1..27: mol_type = other RNA
cagtcctacgactcctccctctccggc

SEQ ID NO: 21106 - RNA, 27 nt, synthetic construct
  misc_feature 1..27: note = derived and/or modified sequence opt2 from anti-HIV_CDR
  source 1..27: mol_type = other RNA
tcccagggcaacaccgccatcgactac

SEQ ID NO: 21107 - RNA, 27 nt, synthetic construct
  misc_feature 1..27: note = derived and/or modified sequence opt2 from anti-HIV_CDR
  source 1..27: mol_type = other RNA
gaggagccccgcgacgccttcgacctc

SEQ ID NO: 21108 - RNA, 27 nt, synthetic construct
  misc_feature 1..27: note = derived and/or modified sequence opt2 from anti-HIV_CDR
  source 1..27: mol_type = other RNA
cagcagtcctacaccacccccgtcacc

SEQ ID NO: 21109 - RNA, 27 nt, synthetic construct
  misc_feature 1..27: note = derived and/or modified sequence opt2 from anti-HIV_CDR
  source 1..27: mol_type = other RNA
gccggccgcgagggctggttcgacccc

SEQ ID NO: 21110 - RNA, 27 nt, synthetic construct
  misc_feature 1..27: note = derived and/or modified sequence opt2 from anti-HIV_CDR
  source 1..27: mol_type = other RNA
cagcagtactactccaccccccacacc

SEQ ID NO: 21111 - RNA, 27 nt, synthetic construct
  misc_feature 1..27: note = derived and/or modified sequence opt2 from anti-HIV_CDR
  source 1..27: mol_type = other RNA
cagcagtcctactccatcgccggcacc

SEQ ID NO: 21112 - RNA, 27 nt, synthetic construct
  misc_feature 1..27: note = derived and/or modified sequence opt2 from anti-HIV_CDR
  source 1..27: mol_type = other RNA
cagaactacaacaagcccccccgcacc

SEQ ID NO: 21113 - RNA, 27 nt, synthetic construct
  misc_feature 1..27: note = derived and/or modified sequence opt2 from anti-HIV_CDR
  source 1..27: mol_type = other RNA
atgcagtccatccagctccccctcacc

SEQ ID NO: 21114 - RNA, 27 nt, synthetic construct
  misc_feature 1..27: note = derived and/or modified sequence opt2 from anti-HIV_CDR
  source 1..27: mol_type = other RNA
atgcaggccctccagacctccctcacc

SEQ ID NO: 21115 - RNA, 27 nt, synthetic construct
  misc_feature 1..27: note = derived and/or modified sequence opt2 from anti-HIV_CDR
  source 1..27: mol_type = other RNA
cagcagtactcctcctccccccgcacc

SEQ ID NO: 21116 - RNA, 27 nt, synthetic construct
  misc_feature 1..27: note = derived and/or modified sequence opt2 from anti-HIV_CDR
  source 1..27: mol_type = other RNA
caggcctgggactcctccaccgccgtc

SEQ ID NO: 21117 - RNA, 27 nt, synthetic construct
  misc_feature 1..27: note = derived and/or modified sequence opt2 from anti-HIV_CDR
  source 1..27: mol_type = other RNA
cagcactacaacaactggccctacacc

SEQ ID NO: 21118 - RNA, 27 nt, synthetic construct
  misc_feature 1..27: note = derived and/or modified sequence opt2 from anti-HIV_CDR
  source 1..27: mol_type = other RNA
cagcagtacgaccgcctccccatcacc

SEQ ID NO: 21119 - RNA, 27 nt, synthetic construct
  misc_feature 1..27: note = derived and/or modified sequence opt2 from anti-HIV_CDR
  source 1..27: mol_type = other RNA
cagcagtacggctcctcccccatcacc

SEQ ID NO: 21120 - RNA, 27 nt, synthetic construct
  misc_feature 1..27: note = derived and/or modified sequence opt2 from anti-HIV_CDR
  source 1..27: mol_type = other RNA
cagcagtacgacgtctggcccctcacc

SEQ ID NO: 21121 - RNA, 27 nt, synthetic construct
  misc_feature 1..27: note = derived and/or modified sequence opt2 from anti-HIV_CDR
  source 1..27: mol_type = other RNA
caccagtacgcctcctccccccgcacc

SEQ ID NO: 21122 - RNA, 27 nt, synthetic construct
  misc_feature 1..27: note = derived and/or modified sequence opt2 from anti-HIV_CDR
  source 1..27: mol_type = other RNA
atgcagtccctccacctcccctacacc

SEQ ID NO: 21123 - RNA, 27 nt, synthetic construct
  misc_feature 1..27: note = derived and/or modified sequence opt2 from anti-HIV_CDR
  source 1..27: mol_type = other RNA
cagcagtactactcctcccccctcacc

SEQ ID NO: 21124 - RNA, 27 nt, synthetic construct
  misc_feature 1..27: note = derived and/or modified sequence opt2 from anti-HIV_CDR
  source 1..27: mol_type = other RNA
cagcagcacgacaccttccccttcacc

SEQ ID NO: 21125 - RNA, 27 nt, synthetic construct
  misc_feature 1..27: note = derived and/or modified sequence opt2 from anti-HIV_CDR
  source 1..27: mol_type = other RNA
cagcagtcctactccaccccctacacc

SEQ ID NO: 21126 - RNA, 27 nt, synthetic construct
  misc_feature 1..27: note = derived and/or modified sequence opt2 from anti-HIV_CDR
  source 1..27: mol_type = other RNA
cagcagtacaagacctaccccgtcacc

SEQ ID NO: 21127 - RNA, 27 nt, synthetic construct
  misc_feature 1..27: note = derived and/or modified sequence opt2 from anti-HIV_CDR
  source 1..27: mol_type = other RNA
cagcagtactactccacccccgtcacc

SEQ ID NO: 21128 - RNA, 27 nt, synthetic construct
  misc_feature 1..27: note = derived and/or modified sequence opt2 from anti-HIV_CDR
  source 1..27: mol_type = other RNA
cagcagtacaactggccccccttcacc

SEQ ID NO: 21129 - RNA, 27 nt, synthetic construct
  misc_feature 1..27: note = derived and/or modified sequence opt2 from anti-HIV_CDR
  source 1..27: mol_type = other RNA
atgcagggcacccactggccctggacc

SEQ ID NO: 21130 - RNA, 27 nt, synthetic construct
  misc_feature 1..27: note = derived and/or modified sequence opt2 from anti-HIV_CDR
  source 1..27: mol_type = other RNA
caccagtgcggctcctccccccgcacc

SEQ ID NO: 21131 - RNA, 27 nt, synthetic construct
  misc_feature 1..27: note = derived and/or modified sequence opt2 from anti-HIV_CDR
  source 1..27: mol_type = other RNA
cagcagtacaactcctacttccgcacc

SEQ ID NO: 21132 - RNA, 27 nt, synthetic construct
  misc_feature 1..27: note = derived and/or modified sequence opt2 from anti-HIV_CDR
  source 1..27: mol_type = other RNA
cagcagtaccacaactggcccccctcc

SEQ ID NO: 21133 - RNA, 27 nt, synthetic construct
  misc_feature 1..27: note = derived and/or modified sequence opt2 from anti-HIV_CDR
  source 1..27: mol_type = other RNA
atgcagggcacctactggctctggacc

SEQ ID NO: 21134 - RNA, 27 nt, synthetic construct
  misc_feature 1..27: note = derived and/or modified sequence opt2 from anti-HIV_CDR
  source 1..27: mol_type = other RNA
cagcagggcttctccgcccccttcacc

SEQ ID NO: 21135 - RNA, 27 nt, synthetic construct
  misc_feature 1..27: note = derived and/or modified sequence opt2 from anti-HIV_CDR
  source 1..27: mol_type = other RNA
cagcagtacaacacctaccccctcacc

SEQ ID NO: 21136 - RNA, 27 nt, synthetic construct
  misc_feature 1..27: note = derived and/or modified sequence opt2 from anti-HIV_CDR
  source 1..27: mol_type = other RNA
atgcagggcacccactggccccgcacc

SEQ ID NO: 21137 - RNA, 27 nt, synthetic construct
  misc_feature 1..27: note = derived and/or modified sequence opt2 from anti-HIV_CDR
  source 1..27: mol_type = other RNA
ttcggccgcaccccctggttcgacccc

SEQ ID NO: 21138 - RNA, 27 nt, synthetic construct
  misc_feature 1..27: note = derived and/or modified sequence opt2 from anti-HIV_CDR
  source 1..27: mol_type = other RNA
cagcagtacttcacctccgtcatcacc

SEQ ID NO: 21139 - RNA, 27 nt, synthetic construct
  misc_feature 1..27: note = derived and/or modified sequence opt2 from anti-HIV_CDR
  source 1..27: mol_type = other RNA
caccactacatgtccgacctccagacc

SEQ ID NO: 21140 - RNA, 27 nt, synthetic construct
  misc_feature 1..27: note = derived and/or modified sequence opt2 from anti-HIV_CDR
  source 1..27: mol_type = other RNA
caccactactcctcctcctcccacacc

SEQ ID NO: 21141 - RNA, 27 nt, synthetic construct
  misc_feature 1..27: note = derived and/or modified sequence opt2 from anti-HIV_CDR
  source 1..27: mol_type = other RNA
caccactacaagtccgactgccagacc

SEQ ID NO: 21142 - RNA, 27 nt, synthetic construct
  misc_feature 1..27: note = derived and/or modified sequence opt2 from anti-HIV_CDR
  source 1..27: mol_type = other RNA
cagcaccgctcctcctggcccctcacc

SEQ ID NO: 21143 - RNA, 27 nt, synthetic construct
  misc_feature 1..27: note = derived and/or modified sequence opt2 from anti-HIV_CDR
  source 1..27: mol_type = other RNA
ctccagcaccactcctacccctggacc

SEQ ID NO: 21144 - RNA, 27 nt, synthetic construct
  misc_feature 1..27: note = derived and/or modified sequence opt2 from anti-HIV_CDR
  source 1..27: mol_type = other RNA
cagcagtacggcacctcccccggcacc

SEQ ID NO: 21145 - RNA, 27 nt, synthetic construct
  misc_feature 1..27: note = derived and/or modified sequence opt2 from anti-HIV_CDR
  source 1..27: mol_type = other RNA
cagcagtacggctcctcccccaccacc

SEQ ID NO: 21146 - RNA, 27 nt, synthetic construct
  misc_feature 1..27: note = derived and/or modified sequence opt2 from anti-HIV_CDR
  source 1..27: mol_type = other RNA
cagcagtacggcacctcccccaccacc

SEQ ID NO: 21147 - RNA, 27 nt, synthetic construct
  misc_feature 1..27: note = derived and/or modified sequence opt2 from anti-HIV_CDR
  source 1..27: mol_type = other RNA
atgcaggccacccactggccccccggc

SEQ ID NO: 21148 - RNA, 27 nt, synthetic construct
  misc_feature 1..27: note = derived and/or modified sequence opt2 from anti-HIV_CDR
  source 1..27: mol_type = other RNA
cagcgctacaaccgcgacccctacatc

SEQ ID NO: 21149 - RNA, 27 nt, synthetic construct
  misc_feature 1..27: note = derived and/or modified sequence opt2 from anti-HIV_CDR
  source 1..27: mol_type = other RNA
cagcagtacgacaacctccccctcgcc

SEQ ID NO: 21150 - RNA, 27 nt, synthetic construct
  misc_feature 1..27: note = derived and/or modified sequence opt2 from anti-HIV_CDR
  source 1..27: mol_type = other RNA
tcctcctactccgccaccggcgtcgcc

SEQ ID NO: 21151 - RNA, 27 nt, synthetic construct
  misc_feature 1..27: note = derived and/or modified sequence opt2 from anti-HIV_CDR
  source 1..27: mol_type = other RNA
cagcactacggcaactcccgctggacc

SEQ ID NO: 21152 - RNA, 27 nt, synthetic construct
  misc_feature 1..27: note = derived and/or modified sequence opt2 from anti-HIV_CDR
  source 1..27: mol_type = other RNA
cagcagtacgagacctacccctggacc

SEQ ID NO: 21153 - RNA, 27 nt, synthetic construct
  misc_feature 1..27: note = derived and/or modified sequence opt2 from anti-HIV_CDR
  source 1..27: mol_type = other RNA
cagcagtacggctcctccccctccacc

SEQ ID NO: 21154 - RNA, 27 nt, synthetic construct
  misc_feature 1..27: note = derived and/or modified sequence opt2 from anti-HIV_CDR
  source 1..27: mol_type = other RNA
cagcagtcccagcgcaccccccacacc

SEQ ID NO: 21155 - RNA, 27 nt, synthetic construct
  misc_feature 1..27: note = derived and/or modified sequence opt2 from anti-HIV_CDR
  source 1..27: mol_type = other RNA
cagcagtacgacatcctccccctcacc

SEQ ID NO: 21156 - RNA, 27 nt, synthetic construct
  misc_feature 1..27: note = derived and/or modified sequence opt2 from anti-HIV_CDR
  source 1..27: mol_type = other RNA
cagcagtccaactcctccccctggacc

SEQ ID NO: 21157 - RNA, 27 nt, synthetic construct
  misc_feature 1..27: note = derived and/or modified sequence opt2 from anti-HIV_CDR
  source 1..27: mol_type = other RNA
cagcagtcctacgacaccccccgcacc

SEQ ID NO: 21158 - RNA, 27 nt, synthetic construct
  misc_feature 1..27: note = derived and/or modified sequence opt2 from anti-HIV_CDR
  source 1..27: mol_type = other RNA
cagcagttcggctcctcccccggcacc

SEQ ID NO: 21159 - RNA, 27 nt, synthetic construct
  misc_feature 1..27: note = derived and/or modified sequence opt2 from anti-HIV_CDR
  source 1..27: mol_type = other RNA
caccagtacggctcctccccccagacc

SEQ ID NO: 21160 - RNA, 27 nt, synthetic construct
  misc_feature 1..27: note = derived and/or modified sequence opt2 from anti-HIV_CDR
  source 1..27: mol_type = other RNA
caccagtacggctcctccccccagtcc

SEQ ID NO: 21161 - RNA, 27 nt, synthetic construct
  misc_feature 1..27: note = derived and/or modified sequence opt2 from anti-HIV_CDR
  source 1..27: mol_type = other RNA
ctccagcacaactcctaccccctcacc

SEQ ID NO: 21162 - RNA, 27 nt, synthetic construct
  misc_feature 1..27: note = derived and/or modified sequence opt2 from anti-HIV_CDR
  source 1..27: mol_type = other RNA
cagcagtacaacgactggcccatcacc

SEQ ID NO: 21163 - RNA, 27 nt, synthetic construct
  misc_feature 1..27: note = derived and/or modified sequence opt2 from anti-HIV_CDR
  source 1..27: mol_type = other RNA
cagcagaccttcaccttcccctacacc

SEQ ID NO: 21164 - RNA, 27 nt, synthetic construct
  misc_feature 1..27: note = derived and/or modified sequence opt2 from anti-HIV_CDR
  source 1..27: mol_type = other RNA
cagcagtcctacaccttcccctacatc

SEQ ID NO: 21165 - RNA, 27 nt, synthetic construct
  misc_feature 1..27: note = derived and/or modified sequence opt2 from anti-HIV_CDR
  source 1..27: mol_type = other RNA
cagtactacggctcctccccctacacc

SEQ ID NO: 21166 - RNA, 27 nt, synthetic construct
  misc_feature 1..27: note = derived and/or modified sequence opt2 from anti-HIV_CDR
  source 1..27: mol_type = other RNA
cagcagtccttcggcaccccccgcacc

SEQ ID NO: 21167 - RNA, 27 nt, synthetic construct
  misc_feature 1..27: note = derived and/or modified sequence opt2 from anti-HIV_CDR
  source 1..27: mol_type = other RNA
cagcagtacaacgactggccccgcacc

SEQ ID NO: 21168 - RNA, 27 nt, synthetic construct
  misc_feature 1..27: note = derived and/or modified sequence opt2 from anti-HIV_CDR
  source 1..27: mol_type = other RNA
cagcagtacggctcctccccccgcacc

SEQ ID NO: 21169 - RNA, 27 nt, synthetic construct
  misc_feature 1..27: note = derived and/or modified sequence opt2 from anti-HIV_CDR
  source 1..27: mol_type = other RNA
ctccagcacaaccgctacccctggacc

SEQ ID NO: 21170 - RNA, 27 nt, synthetic construct
  misc_feature 1..27: note = derived and/or modified sequence opt2 from anti-HIV_CDR
  source 1..27: mol_type = other RNA
ctccagcacaacaactacccctggacc

SEQ ID NO: 21171 - RNA, 27 nt, synthetic construct
  misc_feature 1..27: note = derived and/or modified sequence opt2 from anti-HIV_CDR
  source 1..27: mol_type = other RNA
ctccagtactccacctaccccctcacc

SEQ ID NO: 21172 - RNA, 27 nt, synthetic construct
  misc_feature 1..27: note = derived and/or modified sequence opt2 from anti-HIV_CDR
  source 1..27: mol_type = other RNA
ctccagtacaacgcctaccccctcacc

SEQ ID NO: 21173 - RNA, 27 nt, synthetic construct
  misc_feature 1..27: note = derived and/or modified sequence opt2 from anti-HIV_CDR
  source 1..27: mol_type = other RNA
cagcagtacgactccgcccccgtcacc

SEQ ID NO: 21174 - RNA, 27 nt, synthetic construct
  misc_feature 1..27: note = derived and/or modified sequence opt2 from anti-HIV_CDR
  source 1..27: mol_type = other RNA
cagcagacctacaccttcccctactcc

SEQ ID NO: 21175 - RNA, 27 nt, synthetic construct
  misc_feature 1..27: note = derived and/or modified sequence opt2 from anti-HIV_CDR
  source 1..27: mol_type = other RNA
ggctacgacaactccggccccgactac

SEQ ID NO: 21176 - RNA, 27 nt, synthetic construct
  misc_feature 1..27: note = derived and/or modified sequence opt2 from anti-HIV_CDR
  source 1..27: mol_type = other RNA
cagcagtacaacaactggccccccgcc

SEQ ID NO: 21177 - RNA, 27 nt, synthetic construct
  misc_feature 1..27: note = derived and/or modified sequence opt2 from anti-HIV_CDR
  source 1..27: mol_type = other RNA
caccagtacgccctctccccctggacc

SEQ ID NO: 21178 - RNA, 27 nt, synthetic construct
  misc_feature 1..27: note = derived and/or modified sequence opt2 from anti-HIV_CDR
  source 1..27: mol_type = other RNA
cagaagtacgacaccgaccccatgacc

SEQ ID NO: 21179 - RNA, 27 nt, synthetic construct
  misc_feature 1..27: note = derived and/or modified sequence opt2 from anti-HIV_CDR
  source 1..27: mol_type = other RNA
cagcagtacaactactaccccatcacc

SEQ ID NO: 21180 - RNA, 27 nt, synthetic construct
  misc_feature 1..27: note = derived and/or modified sequence opt2 from anti-HIV_CDR
  source 1..27: mol_type = other RNA
cagcagaccttcaccgaccccgtcacc

SEQ ID NO: 21181 - RNA, 27 nt, synthetic construct
  misc_feature 1..27: note = derived and/or modified sequence opt2 from anti-HIV_CDR
  source 1..27: mol_type = other RNA
gccgcctgggacgactccctccacgtc

SEQ ID NO: 21182 - RNA, 27 nt, synthetic construct
  misc_feature 1..27: note = derived and/or modified sequence opt2 from anti-HIV_CDR
  source 1..27: mol_type = other RNA
cagcagtacgcctcctcccccttcacc

SEQ ID NO: 21183 - RNA, 27 nt, synthetic construct
  misc_feature 1..27: note = derived and/or modified sequence opt2 from anti-HIV_CDR
  source 1..27: mol_type = other RNA
cagcagtcctcctccacccccttcacc

SEQ ID NO: 21184 - RNA, 27 nt, synthetic construct
  misc_feature 1..27: note = derived and/or modified sequence opt2 from anti-HIV_CDR
  source 1..27: mol_type = other RNA
cagcagcgctccaactgggccatcacc

SEQ ID NO: 21185 - RNA, 27 nt, synthetic construct
  misc_feature 1..27: note = derived and/or modified sequence opt2 from anti-HIV_CDR
  source 1..27: mol_type = other RNA
cagcagtacggctcctcccccttcacc

SEQ ID NO: 21186 - RNA, 27 nt, synthetic construct
  misc_feature 1..27: note = derived and/or modified sequence opt2 from anti-HIV_CDR
  source 1..27: mol_type = other RNA
cagaagtacaacggcgccccctggacc

SEQ ID NO: 21187 - RNA, 27 nt, synthetic construct
  misc_feature 1..27: note = derived and/or modified sequence opt2 from anti-HIV_CDR
  source 1..27: mol_type = other RNA
cagaagtacaacaacgccccctggacc

SEQ ID NO: 21188 - RNA, 27 nt, synthetic construct
  misc_feature 1..27: note = derived and/or modified sequence opt2 from anti-HIV_CDR
  source 1..27: mol_type = other RNA
cagcagcgcgtcaactggccccccaac

SEQ ID NO: 21189 - RNA, 27 nt, synthetic construct
  misc_feature 1..27: note = derived and/or modified sequence opt2 from anti-HIV_CDR
  source 1..27: mol_type = other RNA
cagcagcgcggccactggcccctcacc

SEQ ID NO: 21190 - RNA, 27 nt, synthetic construct
  misc_feature 1..27: note = derived and/or modified sequence opt2 from anti-HIV_CDR
  source 1..27: mol_type = other RNA
cagcagtaccgctactccgtcatcatc

SEQ ID NO: 21191 - RNA, 27 nt, synthetic construct
  misc_feature 1..27: note = derived and/or modified sequence opt2 from anti-HIV_CDR
  source 1..27: mol_type = other RNA
cagcagtccggcacctccctcctcacc

SEQ ID NO: 21192 - RNA, 27 nt, synthetic construct
  misc_feature 1..27: note = derived and/or modified sequence opt2 from anti-HIV_CDR
  source 1..27: mol_type = other RNA
atgaagtcccagcactccccccgcacc

SEQ ID NO: 21193 - RNA, 27 nt, synthetic construct
  misc_feature 1..27: note = derived and/or modified sequence opt2 from anti-HIV_CDR
  source 1..27: mol_type = other RNA
atgcagcccctccagaccccctacacc

SEQ ID NO: 21194 - RNA, 27 nt, synthetic construct
  misc_feature 1..27: note = derived and/or modified sequence opt2 from anti-HIV_CDR
  source 1..27: mol_type = other RNA
cagcagtacaccgcctacccctggacc

SEQ ID NO: 21195 - RNA, 27 nt, synthetic construct
  misc_feature 1..27: note = derived and/or modified sequence opt2 from anti-HIV_CDR
  source 1..27: mol_type = other RNA
ctccagaaccacaactacccccgcacc

SEQ ID NO: 21196 - RNA, 27 nt, synthetic construct
  misc_feature 1..27: note = derived and/or modified sequence opt2 from anti-HIV_CDR
  source 1..27: mol_type = other RNA
ctccagacccactcctacccccgcacc

SEQ ID NO: 21197 - RNA, 30 nt, synthetic construct
  misc_feature 1..30: note = derived and/or modified sequence opt2 from anti-HIV_CDR
  source 1..30: mol_type = other RNA
gccgcctgggacgactccttcgactacgtc

SEQ ID NO: 21198 - RNA, 30 nt, synthetic construct
  misc_feature 1..30: note = derived and/or modified sequence opt2 from anti-HIV_CDR
  source 1..30: mol_type = other RNA
cagcactccttcggctcccccccctggacc

SEQ ID NO: 21199 - RNA, 30 nt, synthetic construct
  misc_feature 1..30: note = derived and/or modified sequence opt2 from anti-HIV_CDR
  source 1..30: mol_type = other RNA
tcctccttcacccccaccaacaccctcgtc

SEQ ID NO: 21200 - RNA, 30 nt, synthetic construct
  misc_feature 1..30: note = derived and/or modified sequence opt2 from anti-HIV_CDR
  source 1..30: mol_type = other RNA
cagcagtacggcaccctccacccccgcacc

SEQ ID NO: 21201 - RNA, 30 nt, synthetic construct
  misc_feature 1..30: note = derived and/or modified sequence opt2 from anti-HIV_CDR
  source 1..30: mol_type = other RNA
cagcagtacaacaactggccccccatcacc

SEQ ID NO: 21202 - RNA, 30 nt, synthetic construct
  misc_feature 1..30: note = derived and/or modified sequence opt2 from anti-HIV_CDR
  source 1..30: mol_type = other RNA
cagcagtactaccagtggctctcctacacc

SEQ ID NO: 21203 - RNA, 30 nt, synthetic construct
  misc_feature 1..30: note = derived and/or modified sequence opt2 from anti-HIV_CDR
  source 1..30: mol_type = other RNA
cagcagcgcgccaactggcgcctcctcacc

SEQ ID NO: 21204 - RNA, 30 nt, synthetic construct
  misc_feature 1..30: note = derived and/or modified sequence opt2 from anti-HIV_CDR
  source 1..30: mol_type = other RNA
cgccactccgactactgcgacctcgacgtc

SEQ ID NO: 21205 - RNA, 30 nt, synthetic construct
  misc_feature 1..30: note = derived and/or modified sequence opt2 from anti-HIV_CDR
  source 1..30: mol_type = other RNA
cgccgctccgactactgcgacttcgacgtc

SEQ ID NO: 21206 - RNA, 30 nt, synthetic construct
  misc_feature 1..30: note = derived and/or modified sequence opt2 from anti-HIV_CDR
  source 1..30: mol_type = other RNA
cgccacaccgactactgcgacttcgacgtc

SEQ ID NO: 21207 - RNA, 30 nt, synthetic construct
  misc_feature 1..30: note = derived and/or modified sequence opt2 from anti-HIV_CDR
  source 1..30: mol_type = other RNA
cagcgctccgactactgggacttcgacgtc

SEQ ID NO: 21208 - RNA, 30 nt, synthetic construct
  misc_feature 1..30: note = derived and/or modified sequence opt2 from anti-HIV_CDR
  source 1..30: mol_type = other RNA
cgccactccgactactgcgacttcgacatc

SEQ ID NO: 21209 - RNA, 30 nt, synthetic construct
  misc_feature 1..30: note = derived and/or modified sequence opt2 from anti-HIV_CDR
  source 1..30: mol_type = other RNA
tgcgaggtcgacgccgacgagaccatcacc

SEQ ID NO: 21210 - RNA, 30 nt, synthetic construct
  misc_feature 1..30: note = derived and/or modified sequence opt2 from anti-HIV_CDR
  source 1..30: mol_type = other RNA
tgcgaggtcgacgccgaggagaccatcatc

SEQ ID NO: 21211 - RNA, 30 nt, synthetic construct
  misc_feature 1..30: note = derived and/or modified sequence opt2 from anti-HIV_CDR
  source 1..30: mol_type = other RNA
cagcgctccgacttctgggacttcgacgtc

SEQ ID NO: 21212 - RNA, 30 nt, synthetic construct
  misc_feature 1..30: note = derived and/or modified sequence opt2 from anti-HIV_CDR
  source 1..30: mol_type = other RNA
cgccactccgactactgcgacttcgacgtc

SEQ ID NO: 21213 - RNA, 30 nt, synthetic construct
  misc_feature 1..30: note = derived and/or modified sequence opt2 from anti-HIV_CDR
  source 1..30: mol_type = other RNA
tgctcctacgccggcggccgcaccgtcgtc

SEQ ID NO: 21214 - RNA, 30 nt, synthetic construct
  misc_feature 1..30: note = derived and/or modified sequence opt2 from anti-HIV_CDR
  source 1..30: mol_type = other RNA
gccgcctgggacgactccctcgactacgtc

SEQ ID NO: 21215 - RNA, 30 nt, synthetic construct
  misc_feature 1..30: note = derived and/or modified sequence opt2 from anti-HIV_CDR
  source 1..30: mol_type = other RNA
cagcagcgctccaactggccccgcctcacc

SEQ ID NO: 21216 - RNA, 30 nt, synthetic construct
  misc_feature 1..30: note = derived and/or modified sequence opt2 from anti-HIV_CDR
  source 1..30: mol_type = other RNA
cagcagtacaacaactggccccccttcacc

SEQ ID NO: 21217 - RNA, 30 nt, synthetic construct
  misc_feature 1..30: note = derived and/or modified sequence opt2 from anti-HIV_CDR
  source 1..30: mol_type = other RNA
atgcagggcacctactggccccccctcacc

SEQ ID NO: 21218 - RNA, 30 nt, synthetic construct
  misc_feature 1..30: note = derived and/or modified sequence opt2 from anti-HIV_CDR
  source 1..30: mol_type = other RNA
cagcagtacggctcctccctcctctacacc

SEQ ID NO: 21219 - RNA, 30 nt, synthetic construct
  misc_feature 1..30: note = derived and/or modified sequence opt2 from anti-HIV_CDR
  source 1..30: mol_type = other RNA
cagcagtccttcggcatccccccctggacc

SEQ ID NO: 21220 - RNA, 30 nt, synthetic construct
  misc_feature 1..30: note = derived and/or modified sequence opt2 from anti-HIV_CDR
  source 1..30: mol_type = other RNA
tgctcctacgccggctcctactcctacgtc

SEQ ID NO: 21221 - RNA, 30 nt, synthetic construct
  misc_feature 1..30: note = derived and/or modified sequence opt2 from anti-HIV_CDR
  source 1..30: mol_type = other RNA
tactcctacgccggcaactccctcggcgtc

SEQ ID NO: 21222 - RNA, 30 nt, synthetic construct
  misc_feature 1..30: note = derived and/or modified sequence opt2 from anti-HIV_CDR
  source 1..30: mol_type = other RNA
tcctcctacaccatctcctccccccgcgtc

SEQ ID NO: 21223 - RNA, 30 nt, synthetic construct
  misc_feature 1..30: note = derived and/or modified sequence opt2 from anti-HIV_CDR
  source 1..30: mol_type = other RNA
caggagtgggagctccagcccttcgactac

SEQ ID NO: 21224 - RNA, 30 nt, synthetic construct
  misc_feature 1..30: note = derived and/or modified sequence opt2 from anti-HIV_CDR
  source 1..30: mol_type = other RNA
ctcatccccgtctccggcgccttcgacgtc

SEQ ID NO: 21225 - RNA, 30 nt, synthetic construct; identical to SEQ ID NO: 13583
  misc_feature 1..30: note = derived and/or modified sequence opt2 from anti-HIV_CDR
  source 1..30: mol_type = other RNA

SEQ ID NO: 21226 - RNA, 30 nt, synthetic construct
  misc_feature 1..30: note = derived and/or modified sequence opt2 from anti-HIV_CDR
  source 1..30: mol_type = other RNA
caggagtacggccgctccccccccttcccc

SEQ ID NO: 21227 - RNA, 30 nt, synthetic construct
  misc_feature 1..30: note = derived and/or modified sequence opt2 from anti-HIV_CDR
  source 1..30: mol_type = other RNA
accctcgacggcaacttccactgggacttc

SEQ ID NO: 21228 - RNA, 30 nt, synthetic construct
  misc_feature 1..30: note = derived and/or modified sequence opt2 from anti-HIV_CDR
  source 1..30: mol_type = other RNA
ttcacccagcgccagggcggcttcgactac

SEQ ID NO: 21229 - RNA, 30 nt, synthetic construct
  misc_feature 1..30: note = derived and/or modified sequence opt2 from anti-HIV_CDR
  source 1..30: mol_type = other RNA
cagcagtactacaagtggccccccatcacc

SEQ ID NO: 21230 - RNA, 30 nt, synthetic construct
  misc_feature 1..30: note = derived and/or modified sequence opt2 from anti-HIV_CDR
  source 1..30: mol_type = other RNA
cagcagtacggctcctccgccccctacacc

SEQ ID NO: 21231 - RNA, 30 nt, synthetic construct
  misc_feature 1..30: note = derived and/or modified sequence opt2 from anti-HIV_CDR
  source 1..30: mol_type = other RNA
cagcagctcaactccgaccccccctggacc

SEQ ID NO: 21232 - RNA, 30 nt, synthetic construct
  misc_feature 1..30: note = derived and/or modified sequence opt2 from anti-HIV_CDR
  source 1..30: mol_type = other RNA
cagcaccacggctcctcccccacctggacc

SEQ ID NO: 21233 - RNA, 30 nt, synthetic construct
  misc_feature 1..30: note = derived and/or modified sequence opt2 from anti-HIV_CDR
  source 1..30: mol_type = other RNA
cagcagtacaagaagtggcccccctggacc

SEQ ID NO: 21234 - RNA, 30 nt, synthetic construct
  misc_feature 1..30: note = derived and/or modified sequence opt2 from anti-HIV_CDR
  source 1..30: mol_type = other RNA
cagcagtacggcttctccctccccgtcacc

SEQ ID NO: 21235 - RNA, 30 nt, synthetic construct
  misc_feature 1..30: note = derived and/or modified sequence opt2 from anti-HIV_CDR
  source 1..30: mol_type = other RNA
cagtcctacaacggcgacccccccgtcacc

SEQ ID NO: 21236 - RNA, 30 nt, synthetic construct
  misc_feature 1..30: note = derived and/or modified sequence opt2 from anti-HIV_CDR
  source 1..30: mol_type = other RNA
cagcagtacggctcctcccgccgctggacc

SEQ ID NO: 21237 - RNA, 30 nt, synthetic construct
  misc_feature 1..30: note = derived and/or modified sequence opt2 from anti-HIV_CDR
  source 1..30: mol_type = other RNA
cagcagttcaactcctacccccccctcacc

SEQ ID NO: 21238 - RNA, 30 nt, synthetic construct
  misc_feature 1..30: note = derived and/or modified sequence opt2 from anti-HIV_CDR
  source 1..30: mol_type = other RNA
cgcgagggctcccagggcgccttcgacatc

SEQ ID NO: 21239 - RNA, 30 nt, synthetic construct
  misc_feature 1..30: note = derived and/or modified sequence opt2 from anti-HIV_CDR
  source 1..30: mol_type = other RNA
ggcgactccggccccaccggcttcgactac

SEQ ID NO: 21240 - RNA, 30 nt, synthetic construct
  misc_feature 1..30: note = derived and/or modified sequence opt2 from anti-HIV_CDR
  source 1..30: mol_type = other RNA
gtccgccgcggctcctcctaccccgactac

SEQ ID NO: 21241 - RNA, 30 nt, synthetic construct
  misc_feature 1..30: note = derived and/or modified sequence opt2 from anti-HIV_CDR
  source 1..30: mol_type = other RNA
tccgcctactaccgcaactggttcgactcc

SEQ ID NO: 21242 - RNA, 30 nt, synthetic construct
  misc_feature 1..30: note = derived and/or modified sequence opt2 from anti-HIV_CDR
  source 1..30: mol_type = other RNA
cagtcctacgactcctccgtctccgtcgtc

SEQ ID NO: 21243 - RNA, 30 nt, synthetic construct
  misc_feature 1..30: note = derived and/or modified sequence opt2 from anti-HIV_CDR
  source 1..30: mol_type = other RNA
tcctcctacacctcctccctcaccctcgtc

SEQ ID NO: 21244 - RNA, 30 nt, synthetic construct
  misc_feature 1..30: note = derived and/or modified sequence opt2 from anti-HIV_CDR
  source 1..30: mol_type = other RNA
tacgagggcaagcgctccggcatggacgtc

SEQ ID NO: 21245 - RNA, 30 nt, synthetic construct
  misc_feature 1..30: note = derived and/or modified sequence opt2 from anti-HIV_CDR
  source 1..30: mol_type = other RNA
cagcagtacggctcctcccccgagtacacc

SEQ ID NO: 21246 - RNA, 30 nt, synthetic construct; identical to SEQ ID NO: 13604
  misc_feature 1..30: note = derived and/or modified sequence opt2 from anti-HIV_CDR
  source 1..30: mol_type = other RNA

SEQ ID NO: 21247 - RNA, 30 nt, synthetic construct
  misc_feature 1..30: note = derived and/or modified sequence opt2 from anti-HIV_CDR
  source 1..30: mol_type = other RNA
cagcagtacgacaacctcccccgcgtcacc

SEQ ID NO: 21248 - RNA, 30 nt, synthetic construct
  misc_feature 1..30: note = derived and/or modified sequence opt2 from anti-HIV_CDR
  source 1..30: mol_type = other RNA
ggcgcctacaccaccacctccaccctcgtc

SEQ ID NO: 21249 - RNA, 30 nt, synthetic construct
  misc_feature 1..30: note = derived and/or modified sequence opt2 from anti-HIV_CDR
  source 1..30: mol_type = other RNA
cagcagtacaagtcctactcccccctcacc

SEQ ID NO: 21250 - RNA, 30 nt, synthetic construct
  misc_feature 1..30: note = derived and/or modified sequence opt2 from anti-HIV_CDR
  source 1..30: mol_type = other RNA
cagcagtcctacaacacccgccccctcacc

SEQ ID NO: 21251 - RNA, 30 nt, synthetic construct
  misc_feature 1..30: note = derived and/or modified sequence opt2 from anti-HIV_CDR
  source 1..30: mol_type = other RNA
cagcagtacggcggctccccccccgacacc

SEQ ID NO: 21252 - RNA, 30 nt, synthetic construct
  misc_feature 1..30: note = derived and/or modified sequence opt2 from anti-HIV_CDR
  source 1..30: mol_type = other RNA
tgctcctacacctcctccgccaccgtcgtc

SEQ ID NO: 21253 - RNA, 30 nt, synthetic construct
  misc_feature 1..30: note = derived and/or modified sequence opt2 from anti-HIV_CDR
  source 1..30: mol_type = other RNA
tgctcccacacctcctccgacaccctcgtc

SEQ ID NO: 21254 - RNA, 30 nt, synthetic construct
  misc_feature 1..30: note = derived and/or modified sequence opt2 from anti-HIV_CDR
  source 1..30: mol_type = other RNA
cagcactacggcaactccccccgcgtcacc

SEQ ID NO: 21255 - RNA, 30 nt, synthetic construct
  misc_feature 1..30: note = derived and/or modified sequence opt2 from anti-HIV_CDR
  source 1..30: mol_type = other RNA
gacgccttcgtctcctccgccatggacgtc

SEQ ID NO: 21256 - RNA, 30 nt, synthetic construct
  misc_feature 1..30: note = derived and/or modified sequence opt2 from anti-HIV_CDR
  source 1..30: mol_type = other RNA
ctccgcgccaccacccccggcttcgactac

SEQ ID NO: 21257 - RNA, 30 nt, synthetic construct
  misc_feature 1..30: note = derived and/or modified sequence opt2 from anti-HIV_CDR
  source 1..30: mol_type = other RNA
ctccgcgccaccatccccggcttcgactac

SEQ ID NO: 21258 - RNA, 30 nt, synthetic construct
  misc_feature 1..30: note = derived and/or modified sequence opt2 from anti-HIV_CDR
  source 1..30: mol_type = other RNA
ctccgcgccaccatcgccggcttcgactac

SEQ ID NO: 21259 - RNA, 30 nt, synthetic construct
  misc_feature 1..30: note = derived and/or modified sequence opt2 from anti-HIV_CDR
  source 1..30: mol_type = other RNA
tgctcctacgccggctcctacatctgggtc

SEQ ID NO: 21260 - RNA, 30 nt, synthetic construct
  misc_feature 1..30: note = derived and/or modified sequence opt2 from anti-HIV_CDR
  source 1..30: mol_type = other RNA
tgctcctacgccggcacctactcctacgtc

SEQ ID NO: 21261 - RNA, 30 nt, synthetic construct
  misc_feature 1..30: note = derived and/or modified sequence opt2 from anti-HIV_CDR
  source 1..30: mol_type = other RNA
tcctcctacgccggctccaacaacttcgtc

SEQ ID NO: 21262 - RNA, 30 nt, synthetic construct
  misc_feature 1..30: note = derived and/or modified sequence opt2 from anti-HIV_CDR
  source 1..30: mol_type = other RNA
ggctccttcaccacctccctcaccctcgtc

SEQ ID NO: 21263 - RNA, 30 nt, synthetic construct
  misc_feature 1..30: note = derived and/or modified sequence opt2 from anti-HIV_CDR
  source 1..30: mol_type = other RNA
cagcagtacgccacctcctccctctacacc

SEQ ID NO: 21264 - RNA, 30 nt, synthetic construct
  misc_feature 1..30: note = derived and/or modified sequence opt2 from anti-HIV_CDR
  source 1..30: mol_type = other RNA
cagtggtacggcaccctccacccccgcacc

SEQ ID NO: 21265 - RNA, 30 nt, synthetic construct
  misc_feature 1..30: note = derived and/or modified sequence opt2 from anti-HIV_CDR
  source 1..30: mol_type = other RNA
tcctcctactcctccaccaacacctacgtc

SEQ ID NO: 21266 - RNA, 30 nt, synthetic construct
  misc_feature 1..30: note = derived and/or modified sequence opt2 from anti-HIV_CDR
  source 1..30: mol_type = other RNA
accttcatcaccgcctcctggttcgactcc

SEQ ID NO: 21267 - RNA, 30 nt, synthetic construct
  misc_feature 1..30: note = derived and/or modified sequence opt2 from anti-HIV_CDR
  source 1..30: mol_type = other RNA
accggcggcctcctccgcttccccgaggtc

SEQ ID NO: 21268 - RNA, 30 nt, synthetic construct
  misc_feature 1..30: note = derived and/or modified sequence opt2 from anti-HIV_CDR
  source 1..30: mol_type = other RNA
tgctcctacgccggctcctacacctacgtc

SEQ ID NO: 21269 - RNA, 30 nt, synthetic construct
  misc_feature 1..30: note = derived and/or modified sequence opt2 from anti-HIV_CDR
  source 1..30: mol_type = other RNA
cagcagcgctactcctggccctccctcacc

SEQ ID NO: 21270 - RNA, 30 nt, synthetic construct
  misc_feature 1..30: note = derived and/or modified sequence opt2 from anti-HIV_CDR
  source 1..30: mol_type = other RNA
ctccagtgcggctcctcccccccctacacc

SEQ ID NO: 21271 - RNA, 30 nt, synthetic construct
  misc_feature 1..30: note = derived and/or modified sequence opt2 from anti-HIV_CDR
  source 1..30: mol_type = other RNA
tcctcctacgccggcaccaaccactgggtc

SEQ ID NO: 21272 - RNA, 30 nt, synthetic construct
  misc_feature 1..30: note = derived and/or modified sequence opt2 from anti-HIV_CDR
  source 1..30: mol_type = other RNA
tcctcctacgccgccaccaaccactgggtc

SEQ ID NO: 21273 - RNA, 30 nt, synthetic construct
  misc_feature 1..30: note = derived and/or modified sequence opt2 from anti-HIV_CDR
  source 1..30: mol_type = other RNA
cagtactacggcacctcccccccctccacc

SEQ ID NO: 21274 - RNA, 30 nt, synthetic construct
  misc_feature 1..30: note = derived and/or modified sequence opt2 from anti-HIV_CDR
  source 1..30: mol_type = other RNA
cagtactacggctcctcccccccctccacc

SEQ ID NO: 21275 - RNA, 30 nt, synthetic construct
  misc_feature 1..30: note = derived and/or modified sequence opt2 from anti-HIV_CDR
  source 1..30: mol_type = other RNA
caggagttcggccgcgcccccccctacccc

SEQ ID NO: 21276 - RNA, 30 nt, synthetic construct
  misc_feature 1..30: note = derived and/or modified sequence opt2 from anti-HIV_CDR
  source 1..30: mol_type = other RNA
caggagtacggccgctcccccccctacccc

SEQ ID NO: 21277 - RNA, 30 nt, synthetic construct
  misc_feature 1..30: note = derived and/or modified sequence opt2 from anti-HIV_CDR
  source 1..30: mol_type = other RNA
caggagtacggccgcgcccccccctacccc

SEQ ID NO: 21278 - RNA, 30 nt, synthetic construct
  misc_feature 1..30: note = derived and/or modified sequence opt2 from anti-HIV_CDR
  source 1..30: mol_type = other RNA
cacatcgccgtcggcggctccgaggagcac

SEQ ID NO: 21279 - RNA, 30 nt, synthetic construct
  misc_feature 1..30: note = derived and/or modified sequence opt2 from anti-HIV_CDR
  source 1..30: mol_type = other RNA
cacatcgccgtcggcggctccgaggaccac

SEQ ID NO: 21280 - RNA, 30 nt, synthetic construct
  misc_feature 1..30: note = derived and/or modified sequence opt2 from anti-HIV_CDR
  source 1..30: mol_type = other RNA
cacatcgccgtcggcggccgcgaggaggag

SEQ ID NO: 21281 - RNA, 33 nt, synthetic construct
  misc_feature 1..33: note = derived and/or modified sequence opt2 from anti-HIV_CDR
  source 1..33: mol_type = other RNA
ggcgagaagtcccgcggctcccgcgccgtccag

SEQ ID NO: 21282 - RNA, 33 nt, synthetic construct
  misc_feature 1..33: note = derived and/or modified sequence opt2 from anti-HIV_CDR
  source 1..33: mol_type = other RNA
ggcgagaagtccttcgcctcccgcgccgtccag

SEQ ID NO: 21283 - RNA, 33 nt, synthetic construct
  misc_feature 1..33: note = derived and/or modified sequence opt2 from anti-HIV_CDR
  source 1..33: mol_type = other RNA
ggccgccaggccctcggctcccgcgccgtccag

SEQ ID NO: 21284 - RNA, 33 nt, synthetic construct
  misc_feature 1..33: note = derived and/or modified sequence opt2 from anti-HIV_CDR
  source 1..33: mol_type = other RNA
ggcgaggagtccctcggctcccgctccgtcatc

SEQ ID NO: 21285 - RNA, 33 nt, synthetic construct
  misc_feature 1..33: note = derived and/or modified sequence opt2 from anti-HIV_CDR
  source 1..33: mol_type = other RNA
ggcgagaagtccctcggctcccgcgccgtccag

SEQ ID NO: 21286 - RNA, 33 nt, synthetic construct
  misc_feature 1..33: note = derived and/or modified sequence opt2 from anti-HIV_CDR
  source 1..33: mol_type = other RNA
ggcaaggagtccatcggctcccgcgccgtccag

SEQ ID NO: 21287 - RNA, 33 nt, synthetic construct
  misc_feature 1..33: note = derived and/or modified sequence opt2 from anti-HIV_CDR
  source 1..33: mol_type = other RNA
ggcggcaacaacatcggctccaagtccgtccac

SEQ ID NO: 21288 - RNA, 33 nt, synthetic construct
  misc_feature 1..33: note = derived and/or modified sequence opt2 from anti-HIV_CDR
  source 1..33: mol_type = other RNA
ggcgagaagtccatcggctcccgcgccgtccag

SEQ ID NO: 21289 - RNA, 33 nt, synthetic construct
  misc_feature 1..33: note = derived and/or modified sequence opt2 from anti-HIV_CDR
  source 1..33: mol_type = other RNA
aaggcctcccaggacgtctccaccgccgtcgcc

SEQ ID NO: 21290 - RNA, 33 nt, synthetic construct
  misc_feature 1..33: note = derived and/or modified sequence opt2 from anti-HIV_CDR
  source 1..33: mol_type = other RNA
ggctcccgcaacctctcccaccgcctcctctcc

SEQ ID NO: 21291 - RNA, 33 nt, synthetic construct
  misc_feature 1..33: note = derived and/or modified sequence opt2 from anti-HIV_CDR
  source 1..33: mol_type = other RNA
ggcacctacgactcccagggctccacccgcctc

SEQ ID NO: 21292 - RNA, 33 nt, synthetic construct
  misc_feature 1..33: note = derived and/or modified sequence opt2 from anti-HIV_CDR
  source 1..33: mol_type = other RNA
cagcagcgcaccatctggccccccggctgctcc

SEQ ID NO: 21293 - RNA, 33 nt, synthetic construct
  misc_feature 1..33: note = derived and/or modified sequence opt2 from anti-HIV_CDR
  source 1..33: mol_type = other RNA
ggcacctgggactcctccctctccgccgtcctc

SEQ ID NO: 21294 - RNA, 33 nt, synthetic construct
  misc_feature 1..33: note = derived and/or modified sequence opt2 from anti-HIV_CDR
  source 1..33: mol_type = other RNA
gcctcctgggacaactccctctccggccccgtc

SEQ ID NO: 21295 - RNA, 33 nt, synthetic construct
  misc_feature 1..33: note = derived and/or modified sequence opt2 from anti-HIV_CDR
  source 1..33: mol_type = other RNA
gcctcctgggacgactccctctccggctgggtc

SEQ ID NO: 21296 - RNA, 33 nt, synthetic construct
  misc_feature 1..33: note = derived and/or modified sequence opt2 from anti-HIV_CDR
  source 1..33: mol_type = other RNA
ctcctcctcccctactacggcggcccctggatc

SEQ ID NO: 21297 - RNA, 33 nt, synthetic construct
  misc_feature 1..33: note = derived and/or modified sequence opt2 from anti-HIV_CDR
  source 1..33: mol_type = other RNA
cagcaccgcaccaactggcccccctccatcacc

SEQ ID NO: 21298 - RNA, 33 nt, synthetic construct
  misc_feature 1..33: note = derived and/or modified sequence opt2 from anti-HIV_CDR
  source 1..33: mol_type = other RNA
cagtcctacgaccgctccctccgcggctccgtc

SEQ ID NO: 21299 - RNA, 33 nt, synthetic construct
  misc_feature 1..33: note = derived and/or modified sequence opt2 from anti-HIV_CDR
  source 1..33: mol_type = other RNA
tcctccggcaactacgacttcgccttcgacatc

SEQ ID NO: 21300 - RNA, 33 nt, synthetic construct
  misc_feature 1..33: note = derived and/or modified sequence opt2 from anti-HIV_CDR
  source 1..33: mol_type = other RNA
tcctccggcaactacgacttcgcctacgacatc

SEQ ID NO: 21301 - RNA, 33 nt, synthetic construct
  misc_feature 1..33: note = derived and/or modified sequence opt2 from anti-HIV_CDR
  source 1..33: mol_type = other RNA
tcctccggcaacttcgagttcgccttcgagatc

SEQ ID NO: 21302 - RNA, 33 nt, synthetic construct
  misc_feature 1..33: note = derived and/or modified sequence opt2 from anti-HIV_CDR
  source 1..33: mol_type = other RNA
gccacctacgactcccacggctccatccgcctc

SEQ ID NO: 21303 - RNA, 33 nt, synthetic construct
  misc_feature 1..33: note = derived and/or modified sequence opt2 from anti-HIV_CDR
  source 1..33: mol_type = other RNA
ggcacctacgacacctccctctccctccgcctc

SEQ ID NO: 21304 - RNA, 33 nt, synthetic construct
  misc_feature 1..33: note = derived and/or modified sequence opt2 from anti-HIV_CDR
  source 1..33: mol_type = other RNA
gccgccttcgactccgccctctccctccccctc

SEQ ID NO: 21305 - RNA, 33 nt, synthetic construct
  misc_feature 1..33: note = derived and/or modified sequence opt2 from anti-HIV_CDR
  source 1..33: mol_type = other RNA
gccacctacgactccgacggctccatccgcctc

SEQ ID NO: 21306 - RNA, 33 nt, synthetic construct
  misc_feature 1..33: note = derived and/or modified sequence opt2 from anti-HIV_CDR
  source 1..33: mol_type = other RNA
gccacctacgactccggctggtccatccgcctc

SEQ ID NO: 21307 - RNA, 33 nt, synthetic construct
  misc_feature 1..33: note = derived and/or modified sequence opt2 from anti-HIV_CDR
  source 1..33: mol_type = other RNA
gccacctacgacaccggcctctccctccgcctc

SEQ ID NO: 21308 - RNA, 33 nt, synthetic construct
  misc_feature 1..33: note = derived and/or modified sequence opt2 from anti-HIV_CDR
  source 1..33: mol_type = other RNA
gccgcctacgactccaccctctccctccgcctc

SEQ ID NO: 21309 - RNA, 33 nt, synthetic construct
  misc_feature 1..33: note = derived and/or modified sequence opt2 from anti-HIV_CDR
  source 1..33: mol_type = other RNA
gccgcctacgactccgccgtctccctccccgtc

SEQ ID NO: 21310 - RNA, 33 nt, synthetic construct
  misc_feature 1..33: note = derived and/or modified sequence opt2 from anti-HIV_CDR
  source 1..33: mol_type = other RNA
gccacctacgacaccgacctctccctccgcctc

SEQ ID NO: 21311 - RNA, 33 nt, synthetic construct
  misc_feature 1..33: note = derived and/or modified sequence opt2 from anti-HIV_CDR
  source 1..33: mol_type = other RNA
gccgcctacgactcctccctctccctccgcctc

SEQ ID NO: 21312 - RNA, 33 nt, synthetic construct
  misc_feature 1..33: note = derived and/or modified sequence opt2 from anti-HIV_CDR
  source 1..33: mol_type = other RNA
gccgcctacgactccaccttctccctccccgtc

SEQ ID NO: 21313 - RNA, 33 nt, synthetic construct
  misc_feature 1..33: note = derived and/or modified sequence opt2 from anti-HIV_CDR
  source 1..33: mol_type = other RNA
gccacctacgactcccagggctccacccgcctc

SEQ ID NO: 21314 - RNA, 33 nt, synthetic construct
  misc_feature 1..33: note = derived and/or modified sequence opt2 from anti-HIV_CDR
  source 1..33: mol_type = other RNA
gccacctacgactcccagcgctccatccgcctc

SEQ ID NO: 21315 - RNA, 33 nt, synthetic construct
  misc_feature 1..33: note = derived and/or modified sequence opt2 from anti-HIV_CDR
  source 1..33: mol_type = other RNA
gccgtctacgactcctccctctccctcggcctc

SEQ ID NO: 21316 - RNA, 33 nt, synthetic construct
  misc_feature 1..33: note = derived and/or modified sequence opt2 from anti-HIV_CDR
  source 1..33: mol_type = other RNA
cagcaccgctccatctggcccctcatgtgcacc

SEQ ID NO: 21317 - RNA, 33 nt, synthetic construct
  misc_feature 1..33: note = derived and/or modified sequence opt2 from anti-HIV_CDR
  source 1..33: mol_type = other RNA
ctccagcccgtctacatcttccgcggcacctgg

SEQ ID NO: 21318 - RNA, 33 nt, synthetic construct
  misc_feature 1..33: note = derived and/or modified sequence opt2 from anti-HIV_CDR
  source 1..33: mol_type = other RNA
tgcgaggtcgacgccgacgagaccgtcacctgc

SEQ ID NO: 21319 - RNA, 33 nt, synthetic construct
  misc_feature 1..33: note = derived and/or modified sequence opt2 from anti-HIV_CDR
  source 1..33: mol_type = other RNA
tgcgaggtcgacgccgaggtcaccatgaccgtc

SEQ ID NO: 21320 - RNA, 33 nt, synthetic construct
  misc_feature 1..33: note = derived and/or modified sequence opt2 from anti-HIV_CDR
  source 1..33: mol_type = other RNA
tcctcctacgccgacaccaacgacttcggcgtc

SEQ ID NO: 21321 - RNA, 33 nt, synthetic construct
  misc_feature 1..33: note = derived and/or modified sequence opt2 from anti-HIV_CDR
  source 1..33: mol_type = other RNA
tgctccttcacctacgtcaaccccacctacctc

SEQ ID NO: 21322 - RNA, 33 nt, synthetic construct
  misc_feature 1..33: note = derived and/or modified sequence opt2 from anti-HIV_CDR
  source 1..33: mol_type = other RNA
ggcacctgggacggctccctcaccaccggcgtc

SEQ ID NO: 21323 - RNA, 33 nt, synthetic construct
  misc_feature 1..33: note = derived and/or modified sequence opt2 from anti-HIV_CDR
  source 1..33: mol_type = other RNA
cagtcctacgacaactccctctccggctgggtc

SEQ ID NO: 21324 - RNA, 33 nt, synthetic construct
  misc_feature 1..33: note = derived and/or modified sequence opt2 from anti-HIV_CDR
  source 1..33: mol_type = other RNA
cagcagtactactccatccccccctggaccttc

SEQ ID NO: 21325 - RNA, 33 nt, synthetic construct
  misc_feature 1..33: note = derived and/or modified sequence opt2 from anti-HIV_CDR
  source 1..33: mol_type = other RNA
atgcagggcacctactggcccccctccatcacc

SEQ ID NO: 21326 - RNA, 33 nt, synthetic construct
  misc_feature 1..33: note = derived and/or modified sequence opt2 from anti-HIV_CDR
  source 1..33: mol_type = other RNA
cagtcctacgactcctccctcggcgtcgaggtc

SEQ ID NO: 21327 - RNA, 33 nt, synthetic construct
  misc_feature 1..33: note = derived and/or modified sequence opt2 from anti-HIV_CDR
  source 1..33: mol_type = other RNA
caggtctgggactccggccgcgactcctgggtc

SEQ ID NO: 21328 - RNA, 33 nt, synthetic construct
  misc_feature 1..33: note = derived and/or modified sequence opt2 from anti-HIV_CDR
  source 1..33: mol_type = other RNA
cagtcctacgactcctccctctccggctgggtc

SEQ ID NO: 21329 - RNA, 33 nt, synthetic construct
  misc_feature 1..33: note = derived and/or modified sequence opt2 from anti-HIV_CDR
  source 1..33: mol_type = other RNA
ggctcctgggacggctccctcaacgccggcgtc

SEQ ID NO: 21330 - RNA, 33 nt, synthetic construct
  misc_feature 1..33: note = derived and/or modified sequence opt2 from anti-HIV_CDR
  source 1..33: mol_type = other RNA
ctctccgccgactcctcctccacctaccaggtc

SEQ ID NO: 21331 - RNA, 33 nt, synthetic construct
  misc_feature 1..33: note = derived and/or modified sequence opt2 from anti-HIV_CDR
  source 1..33: mol_type = other RNA
tgctcctacgccggccgcgacacctcctgggtc

SEQ ID NO: 21332 - RNA, 33 nt, synthetic construct
  misc_feature 1..33: note = derived and/or modified sequence opt2 from anti-HIV_CDR
  source 1..33: mol_type = other RNA
cagcagcgctccaactggccccccggcctcacc

SEQ ID NO: 21333 - RNA, 33 nt, synthetic construct
  misc_feature 1..33: note = derived and/or modified sequence opt2 from anti-HIV_CDR
  source 1..33: mol_type = other RNA
aagggccgcggctacggctactggttcgactcc

SEQ ID NO: 21334 - RNA, 33 nt, synthetic construct
  misc_feature 1..33: note = derived and/or modified sequence opt2 from anti-HIV_CDR
  source 1..33: mol_type = other RNA
gagatggccgccacctccgacgccttcgacatc

SEQ ID NO: 21335 - RNA, 33 nt, synthetic construct
  misc_feature 1..33: note = derived and/or modified sequence opt2 from anti-HIV_CDR
  source 1..33: mol_type = other RNA
tccatctactccaccggccccgcccccgtctac

SEQ ID NO: 21336 - RNA, 33 nt, synthetic construct
  misc_feature 1..33: note = derived and/or modified sequence opt2 from anti-HIV_CDR
  source 1..33: mol_type = other RNA
cgcggctccctcctcatcaagtacttcgactac

SEQ ID NO: 21337 - RNA, 33 nt, synthetic construct
  misc_feature 1..33: note = derived and/or modified sequence opt2 from anti-HIV_CDR
  source 1..33: mol_type = other RNA
cagcagtacgacaacctccccccccgcgtcacc

SEQ ID NO: 21338 - RNA, 33 nt, synthetic construct
  misc_feature 1..33: note = derived and/or modified sequence opt2 from anti-HIV_CDR
  source 1..33: mol_type = other RNA
gacgtccgcctcgtcgccgtccccggcgccgac

SEQ ID NO: 21339 - RNA, 33 nt, synthetic construct
  misc_feature 1..33: note = derived and/or modified sequence opt2 from anti-HIV_CDR
  source 1..33: mol_type = other RNA
cagcagcgcaccacctggccccccgagtacacc

SEQ ID NO: 21340 - RNA, 33 nt, synthetic construct
  misc_feature 1..33: note = derived and/or modified sequence opt2 from anti-HIV_CDR
  source 1..33: mol_type = other RNA
gccgcctgggacgactccctcaacggctgggtc

SEQ ID NO: 21341 - RNA, 33 nt, synthetic construct
  misc_feature 1..33: note = derived and/or modified sequence opt2 from anti-HIV_CDR
  source 1..33: mol_type = other RNA
cgccgccgctccgcctggtcccccttcgactcc

SEQ ID NO: 21342 - RNA, 33 nt, synthetic construct
  misc_feature 1..33: note = derived and/or modified sequence opt2 from anti-HIV_CDR
  source 1..33: mol_type = other RNA
gccacctgggactcctccctccgcaccgccctc

SEQ ID NO: 21343 - RNA, 33 nt, synthetic construct
  misc_feature 1..33: note = derived and/or modified sequence opt2 from anti-HIV_CDR
  source 1..33: mol_type = other RNA
ggcacctgggactcctccctccgcgccgccctc

SEQ ID NO: 21344 - RNA, 33 nt, synthetic construct
  misc_feature 1..33: note = derived and/or modified sequence opt2 from anti-HIV_CDR
  source 1..33: mol_type = other RNA
cagcagcgctccatctggcccccctccctcacc

SEQ ID NO: 21345 - RNA, 33 nt, synthetic construct
  misc_feature 1..33: note = derived and/or modified sequence opt2 from anti-HIV_CDR
  source 1..33: mol_type = other RNA
gagttccagacctccggcgtcgtccgcgagggc

SEQ ID NO: 21346 - RNA, 33 nt, synthetic construct
  misc_feature 1..33: note = derived and/or modified sequence opt2 from anti-HIV_CDR
  source 1..33: mol_type = other RNA
cacatcggcgccggcggcccctactccgagtac

SEQ ID NO: 21347 - RNA, 33 nt, synthetic construct
  misc_feature 1..33: note = derived and/or modified sequence opt2 from anti-HIV_CDR
  source 1..33: mol_type = other RNA
cgcggccactccttcacctcccccttcgactcc

SEQ ID NO: 21348 - RNA, 33 nt, synthetic construct
  misc_feature 1..33: note = derived and/or modified sequence opt2 from anti-HIV_CDR
  source 1..33: mol_type = other RNA
cagcacctcaactcctacccccgcatgtacacc

SEQ ID NO: 21349 - RNA, 33 nt, synthetic construct
  misc_feature 1..33: note = derived and/or modified sequence opt2 from anti-HIV_CDR
  source 1..33: mol_type = other RNA
cagcagcgctccaactggccccccaagatcacc

SEQ ID NO: 21350 - RNA, 33 nt, synthetic construct
  misc_feature 1..33: note = derived and/or modified sequence opt2 from anti-HIV_CDR
  source 1..33: mol_type = other RNA
gccgcctgggacgactccctcggcggcgtcgtc

SEQ ID NO: 21351 - RNA, 33 nt, synthetic construct
  misc_feature 1..33: note = derived and/or modified sequence opt2 from anti-HIV_CDR
  source 1..33: mol_type = other RNA
ggcacctgggactcctccctctccgccgtcgtc

SEQ ID NO: 21352 - RNA, 33 nt, synthetic construct
  misc_feature 1..33: note = derived and/or modified sequence opt2 from anti-HIV_CDR
  source 1..33: mol_type = other RNA
cagcagcgcgccaactggccccccggcggcacc

SEQ ID NO: 21353 - RNA, 33 nt, synthetic construct
  misc_feature 1..33: note = derived and/or modified sequence opt2 from anti-HIV_CDR
  source 1..33: mol_type = other RNA
ggcggcggctacccccgcggcaacatggacgtc

SEQ ID NO: 21354 - RNA, 33 nt, synthetic construct
  misc_feature 1..33: note = derived and/or modified sequence opt2 from anti-HIV_CDR
  source 1..33: mol_type = other RNA
ctcctcctcctctactacggcggcccctggatc

SEQ ID NO: 21355 - RNA, 33 nt, synthetic construct
  misc_feature 1..33: note = derived and/or modified sequence opt2 from anti-HIV_CDR
  source 1..33: mol_type = other RNA
cagcagcgcggcatctggcccctccagatcacc

SEQ ID NO: 21356 - RNA, 33 nt, synthetic construct
  misc_feature 1..33: note = derived and/or modified sequence opt2 from anti-HIV_CDR
  source 1..33: mol_type = other RNA
cgctcccccggcggcggctacgccttcgacatc

SEQ ID NO: 21357 - RNA, 33 nt, synthetic construct
  misc_feature 1..33: note = derived and/or modified sequence opt2 from anti-HIV_CDR
  source 1..33: mol_type = other RNA
tccggccccggcctcctccgcggcttcgactac

SEQ ID NO: 21358 - RNA, 33 nt, synthetic construct
  misc_feature 1..33: note = derived and/or modified sequence opt2 from anti-HIV_CDR
  source 1..33: mol_type = other RNA
cagcagcgcaccacccgcccccccgagtacacc

SEQ ID NO: 21359 - RNA, 33 nt, synthetic construct
  misc_feature 1..33: note = derived and/or modified sequence opt2 from anti-HIV_CDR
  source 1..33: mol_type = other RNA
cagcagcgcaccacccgcccccccgactacacc

SEQ ID NO: 21360 - RNA, 33 nt, synthetic construct
  misc_feature 1..33: note = derived and/or modified sequence opt2 from anti-HIV_CDR
  source 1..33: mol_type = other RNA
cagggccgcaccacccgcccccccgactacacc

SEQ ID NO: 21361 - RNA, 33 nt, synthetic construct
  misc_feature 1..33: note = derived and/or modified sequence opt2 from anti-HIV_CDR
  source 1..33: mol_type = other RNA
cagcagcgctccaccaccccccccgagtacacc

SEQ ID NO: 21362 - RNA, 33 nt, synthetic construct
  misc_feature 1..33: note = derived and/or modified sequence opt2 from anti-HIV_CDR
  source 1..33: mol_type = other RNA
cagcagcgcacctcctggcccctcgccctctcc

SEQ ID NO: 21363 - RNA, 33 nt, synthetic construct
  misc_feature 1..33: note = derived and/or modified sequence opt2 from anti-HIV_CDR
  source 1..33: mol_type = other RNA
cgcggccactccttctccctccccttcgactcc

SEQ ID NO: 21364 - RNA, 36 nt, synthetic construct
  misc_feature 1..36: note = derived and/or modified sequence opt2 from anti-HIV_CDR
  source 1..36: mol_type = other RNA
cactactgggactcccgctcccccatctcctgggtc

SEQ ID NO: 21365 - RNA, 36 nt, synthetic construct
  misc_feature 1..36: note = derived and/or modified sequence opt2 from anti-HIV_CDR
  source 1..36: mol_type = other RNA
cacaagtgggactcccgctcccccctctcctgggtc

SEQ ID NO: 21366 - RNA, 36 nt, synthetic construct
  misc_feature 1..36: note = derived and/or modified sequence opt2 from anti-HIV_CDR
  source 1..36: mol_type = other RNA
cacatgtgggactcccgctccggcttctcctggtcc

SEQ ID NO: 21367 - RNA, 36 nt, synthetic construct
  misc_feature 1..36: note = derived and/or modified sequence opt2 from anti-HIV_CDR
  source 1..36: mol_type = other RNA
cacatctgggactcccgcgtccccaccaagtgggtc

SEQ ID NO: 21368 - RNA, 36 nt, synthetic construct
  misc_feature 1..36: note = derived and/or modified sequence opt2 from anti-HIV_CDR
  source 1..36: mol_type = other RNA
caggtctgggactcctcctccgaccacccctgggtc

SEQ ID NO: 21369 - RNA, 36 nt, synthetic construct
  misc_feature 1..36: note = derived and/or modified sequence opt2 from anti-HIV_CDR
  source 1..36: mol_type = other RNA
cacatctacgacgcccgccgccccaccaactgggtc

SEQ ID NO: 21370 - RNA, 36 nt, synthetic construct
  misc_feature 1..36: note = derived and/or modified sequence opt2 from anti-HIV_CDR
  source 1..36: mol_type = other RNA
ctcgacggcgaggccttccgctactacctcgacctc

SEQ ID NO: 21371 - RNA, 36 nt, synthetic construct
  misc_feature 1..36: note = derived and/or modified sequence opt2 from anti-HIV_CDR
  source 1..36: mol_type = other RNA
ccccagtacaacctcggccgcgaccccctcgacgtc

SEQ ID NO: 21372 - RNA, 36 nt, synthetic construct
  misc_feature 1..36: note = derived and/or modified sequence opt2 from anti-HIV_CDR
  source 1..36: mol_type = other RNA
cccgagccctcctccatcgtcgcccccctctactac

SEQ ID NO: 21373 - RNA, 36 nt, synthetic construct
  misc_feature 1..36: note = derived and/or modified sequence opt2 from anti-HIV_CDR
  source 1..36: mol_type = other RNA
ggcggcggcgacggccgcaactggcacctccacccc

SEQ ID NO: 21374 - RNA, 36 nt, synthetic construct
  misc_feature 1..36: note = derived and/or modified sequence opt2 from anti-HIV_CDR
  source 1..36: mol_type = other RNA
cccaagtccggccgcgactactggtccttcgacctc

SEQ ID NO: 21375 - RNA, 36 nt, synthetic construct
  misc_feature 1..36: note = derived and/or modified sequence opt2 from anti-HIV_CDR
  source 1..36: mol_type = other RNA
ccccgcggcggccgcgacaactggtccttccacgtc

SEQ ID NO: 21376 - RNA, 36 nt, synthetic construct
  misc_feature 1..36: note = derived and/or modified sequence opt2 from anti-HIV_CDR
  source 1..36: mol_type = other RNA
ccccactcccccgacgacgcctggtccctcgacgtc

SEQ ID NO: 21377 - RNA, 36 nt, synthetic construct
  misc_feature 1..36: note = derived and/or modified sequence opt2 from anti-HIV_CDR
  source 1..36: mol_type = other RNA
cccctccgcggcggcgacacctggcactaccactcc

SEQ ID NO: 21378 - RNA, 36 nt, synthetic construct
  misc_feature 1..36: note = derived and/or modified sequence opt2 from anti-HIV_CDR
  source 1..36: mol_type = other RNA
ctccagcccgtctacatcctccgctccatctgccac

SEQ ID NO: 21379 - RNA, 36 nt, synthetic construct
  misc_feature 1..36: note = derived and/or modified sequence opt2 from anti-HIV_CDR
  source 1..36: mol_type = other RNA
ctccagcccgtctacatcctcaagtgcaactggtgc

SEQ ID NO: 21380 - RNA, 36 nt, synthetic construct
  misc_feature 1..36: note = derived and/or modified sequence opt2 from anti-HIV_CDR
  source 1..36: mol_type = other RNA
gagtaccgcttcgacgactggggccccctcgaccac

SEQ ID NO: 21381 - RNA, 36 nt, synthetic construct
  misc_feature 1..36: note = derived and/or modified sequence opt2 from anti-HIV_CDR
  source 1..36: mol_type = other RNA
gccgcctgggacgactccctcaacggccacggcgtc

SEQ ID NO: 21382 - RNA, 36 nt, synthetic construct
  misc_feature 1..36: note = derived and/or modified sequence opt2 from anti-HIV_CDR
  source 1..36: mol_type = other RNA
ctctacttcgactgggccccccacgccttcgacatc

SEQ ID NO: 21383 - RNA, 36 nt, synthetic construct
  misc_feature 1..36: note = derived and/or modified sequence opt2 from anti-HIV_CDR
  source 1..36: mol_type = other RNA
ggcctctacgactcctccggctactacttcggctac

SEQ ID NO: 21384 - RNA, 36 nt, synthetic construct
  misc_feature 1..36: note = derived and/or modified sequence opt2 from anti-HIV_CDR
  source 1..36: mol_type = other RNA
ctcggctgctccggcggctcctgctacgaggactcc

SEQ ID NO: 21385 - RNA, 36 nt, synthetic construct
  misc_feature 1..36: note = derived and/or modified sequence opt2 from anti-HIV_CDR
  source 1..36: mol_type = other RNA
gcctccggctcctacatcctcggcaccatggacgtc

SEQ ID NO: 21386 - RNA, 36 nt, synthetic construct
  misc_feature 1..36: note = derived and/or modified sequence opt2 from anti-HIV_CDR
  source 1..36: mol_type = other RNA
tactccaccgacaactccggcaagcagcactgggtc

SEQ ID NO: 21387 - RNA, 36 nt, synthetic construct
  misc_feature 1..36: note = derived and/or modified sequence opt2 from anti-HIV_CDR
  source 1..36: mol_type = other RNA
gtcaagcagttcctcgagtggctctacctcgactac

SEQ ID NO: 21388 - RNA, 36 nt, synthetic construct
  misc_feature 1..36: note = derived and/or modified sequence opt2 from anti-HIV_CDR
  source 1..36: mol_type = other RNA
ggcgtccgctccatcgtcggcgcccacttcgactac

SEQ ID NO: 21389 - RNA, 36 nt, synthetic construct
  misc_feature 1..36: note = derived and/or modified sequence opt2 from anti-HIV_CDR
  source 1..36: mol_type = other RNA
ggcgtcggcacccgctactacgtctacttcgactcc

SEQ ID NO: 21390 - RNA, 36 nt, synthetic construct
  misc_feature 1..36: note = derived and/or modified sequence opt2 from anti-HIV_CDR
  source 1..36: mol_type = other RNA
gccccctacatctcctcctcccacctcgactactgg

SEQ ID NO: 21391 - RNA, 36 nt, synthetic construct
  misc_feature 1..36: note = derived and/or modified sequence opt2 from anti-HIV_CDR
  source 1..36: mol_type = other RNA
cgcggcatcgccgccgccggcttctacttccagcac

SEQ ID NO: 21392 - RNA, 36 nt, synthetic construct
  misc_feature 1..36: note = derived and/or modified sequence opt2 from anti-HIV_CDR
  source 1..36: mol_type = other RNA
cgcggcatcgccgccgccgccttctacttccagacc

SEQ ID NO: 21393 - RNA, 36 nt, synthetic construct
  misc_feature 1..36: note = derived and/or modified sequence opt2 from anti-HIV_CDR
  source 1..36: mol_type = other RNA
cgcggcatcgccgccgccggcttctacttccagaac

SEQ ID NO: 21394 - RNA, 36 nt, synthetic construct
  misc_feature 1..36: note = derived and/or modified sequence opt2 from anti-HIV_CDR
  source 1..36: mol_type = other RNA
cagtcctacgacacctccctcaccgacaccggcgtc

SEQ ID NO: 21395 - RNA, 36 nt, synthetic construct
  misc_feature 1..36: note = derived and/or modified sequence opt2 from anti-HIV_CDR
  source 1..36: mol_type = other RNA
cagtcctacgacacctccctctccgacaccggcgtc

SEQ ID NO: 21396 - RNA, 36 nt, synthetic construct
  misc_feature 1..36: note = derived and/or modified sequence opt2 from anti-HIV_CDR
  source 1..36: mol_type = other RNA
cgcaccaccctcgtcaacttcggcgtcttcgacctc

SEQ ID NO: 21397 - RNA, 36 nt, synthetic construct
  misc_feature 1..36: note = derived and/or modified sequence opt2 from anti-HIV_CDR
  source 1..36: mol_type = other RNA
cccgtcgtcaacaccatcctcccctactgcgacgtc

SEQ ID NO: 21398 - RNA, 36 nt, synthetic construct
  misc_feature 1..36: note = derived and/or modified sequence opt2 from anti-HIV_CDR
  source 1..36: mol_type = other RNA
tgctactccggccgctcccgctacttcttcgactcc

SEQ ID NO: 21399 - RNA, 36 nt, synthetic construct
  misc_feature 1..36: note = derived and/or modified sequence opt2 from anti-HIV_CDR
  source 1..36: mol_type = other RNA
gccgcctgggacgactccctcgacggcttctgggtc

SEQ ID NO: 21400 - RNA, 36 nt, synthetic construct
  misc_feature 1..36: note = derived and/or modified sequence opt2 from anti-HIV_CDR
  source 1..36: mol_type = other RNA
ctccgccgcggctactacgactccggcgaggactac

SEQ ID NO: 21401 - RNA, 36 nt, synthetic construct
  misc_feature 1..36: note = derived and/or modified sequence opt2 from anti-HIV_CDR
  source 1..36: mol_type = other RNA
ctccgccgcggctacttcgactccggcggcgaccac

SEQ ID NO: 21402 - RNA, 36 nt, synthetic construct
  misc_feature 1..36: note = derived and/or modified sequence opt2 from anti-HIV_CDR
  source 1..36: mol_type = other RNA
tcctcctacacctcctcctccaccctcggcgtcgtc

SEQ ID NO: 21403 - RNA, 36 nt, synthetic construct
  misc_feature 1..36: note = derived and/or modified sequence opt2 from anti-HIV_CDR
  source 1..36: mol_type = other RNA
ctcgacggcgaggccttccgctactacttcgactcc

SEQ ID NO: 21404 - RNA, 36 nt, synthetic construct
  misc_feature 1..36: note = derived and/or modified sequence opt2 from anti-HIV_CDR
  source 1..36: mol_type = other RNA
cgccgcggccagcgcctcctcgcctacttcgactac

SEQ ID NO: 21405 - RNA, 36 nt, synthetic construct
  misc_feature 1..36: note = derived and/or modified sequence opt2 from anti-HIV_CDR
  source 1..36: mol_type = other RNA
ccccagtacaacctcggccgcgagcccctcaacgtc

SEQ ID NO: 21406 - RNA, 36 nt, synthetic construct
  misc_feature 1..36: note = derived and/or modified sequence opt2 from anti-HIV_CDR
  source 1..36: mol_type = other RNA
gcccaccacgacttctggcgcgcccccgtcgacgtc

SEQ ID NO: 21407 - RNA, 36 nt, synthetic construct
  misc_feature 1..36: note = derived and/or modified sequence opt2 from anti-HIV_CDR
  source 1..36: mol_type = other RNA
ggccgccgcgagggcctcaacttcctcctcgactac

SEQ ID NO: 21408 - RNA, 36 nt, synthetic construct
  misc_feature 1..36: note = derived and/or modified sequence opt2 from anti-HIV_CDR
  source 1..36: mol_type = other RNA
cccgagccctcctccatcgtcggcgccctctactac

SEQ ID NO: 21409 - RNA, 36 nt, synthetic construct
  misc_feature 1..36: note = derived and/or modified sequence opt2 from anti-HIV_CDR
  source 1..36: mol_type = other RNA
ggccccgacgacttctggtccggctaccccaagtac

SEQ ID NO: 21410 - RNA, 36 nt, synthetic construct
  misc_feature 1..36: note = derived and/or modified sequence opt2 from anti-HIV_CDR
  source 1..36: mol_type = other RNA
gactactccgccgccggccgccacctcttcgactcc

SEQ ID NO: 21411 - RNA, 36 nt, synthetic construct
  misc_feature 1..36: note = derived and/or modified sequence opt2 from anti-HIV_CDR
  source 1..36: mol_type = other RNA
gactacaccgcccgcggccgccacttcttcgactac

SEQ ID NO: 21412 - RNA, 36 nt, synthetic construct
  misc_feature 1..36: note = derived and/or modified sequence opt2 from anti-HIV_CDR
  source 1..36: mol_type = other RNA
gactacaccgcctccggccgccacttcttcgactac

SEQ ID NO: 21413 - RNA, 36 nt, synthetic construct
  misc_feature 1..36: note = derived and/or modified sequence opt2 from anti-HIV_CDR
  source 1..36: mol_type = other RNA
cagtcctacgactcctccctctccggctcctgggtc

SEQ ID NO: 21414 - RNA, 36 nt, synthetic construct
  misc_feature 1..36: note = derived and/or modified sequence opt2 from anti-HIV_CDR
  source 1..36: mol_type = other RNA
cccgcccaggccggcgtcggcccccgcttcgactac

SEQ ID NO: 21415 - RNA, 36 nt, synthetic construct
  misc_feature 1..36: note = derived and/or modified sequence opt2 from anti-HIV_CDR
  source 1..36: mol_type = other RNA
ggcgccatcaactcctcccccctctacttcgactcc

SEQ ID NO: 21416 - RNA, 36 nt, synthetic construct
  misc_feature 1..36: note = derived and/or modified sequence opt2 from anti-HIV_CDR
  source 1..36: mol_type = other RNA
ggcgacatcacctcctcccccctctacttcgacttc

SEQ ID NO: 21417 - RNA, 36 nt, synthetic construct
  misc_feature 1..36: note = derived and/or modified sequence opt2 from anti-HIV_CDR
  source 1..36: mol_type = other RNA
ggcgccatcaactcctccccctcctacttcgactcc

SEQ ID NO: 21418 - RNA, 36 nt, synthetic construct
  misc_feature 1..36: note = derived and/or modified sequence opt2 from anti-HIV_CDR
  source 1..36: mol_type = other RNA
tgggtcgtcaccgccgccgaggagtacttcgactac

SEQ ID NO: 21419 - RNA, 39 nt, synthetic construct
  misc_feature 1..39: note = derived and/or modified sequence opt2 from anti-HIV_CDR
  source 1..39: mol_type = other RNA
gacccccaggtcgaggtccgcggcaacgccttcgacatc

SEQ ID NO: 21420 - RNA, 39 nt, synthetic construct
  misc_feature 1..39: note = derived and/or modified sequence opt2 from anti-HIV_CDR
  source 1..39: mol_type = other RNA
gaccacggcgacccccgcaccggctactacttcgactac

SEQ ID NO: 21421 - RNA, 39 nt, synthetic construct
  misc_feature 1..39: note = derived and/or modified sequence opt2 from anti-HIV_CDR
  source 1..39: mol_type = other RNA
gacgagtccggctacgacctcaactggcacctcgactcc

SEQ ID NO: 21422 - RNA, 39 nt, synthetic construct
  misc_feature 1..39: note = derived and/or modified sequence opt2 from anti-HIV_CDR
  source 1..39: mol_type = other RNA
gacggctccggcgacgaccgcaactggcacctcgacccc

SEQ ID NO: 21423 - RNA, 39 nt, synthetic construct
  misc_feature 1..39: note = derived and/or modified sequence opt2 from anti-HIV_CDR
  source 1..39: mol_type = other RNA
gaccgccgcgacgacggcctcgactggctcctcgacccc

SEQ ID NO: 21424 - RNA, 39 nt, synthetic construct
  misc_feature 1..39: note = derived and/or modified sequence opt2 from anti-HIV_CDR
  source 1..39: mol_type = other RNA
gacggcggcggcgacgaccgcacctggctcctcgacgcc

SEQ ID NO: 21425 - RNA, 39 nt, synthetic construct
  misc_feature 1..39: note = derived and/or modified sequence opt2 from anti-HIV_CDR
  source 1..39: mol_type = other RNA
gacggctccggcgacgcccgcgactggcacctccacccc

SEQ ID NO: 21426 - RNA, 39 nt, synthetic construct
  misc_feature 1..39: note = derived and/or modified sequence opt2 from anti-HIV_CDR
  source 1..39: mol_type = other RNA
gacggctccggcgacgacacctcctggtacctcgacccc

SEQ ID NO: 21427 - RNA, 39 nt, synthetic construct
  misc_feature 1..39: note = derived and/or modified sequence opt2 from anti-HIV_CDR
  source 1..39: mol_type = other RNA
gacggctccggcgacgacacctcctggcacctcgacccc

SEQ ID NO: 21428 - RNA, 39 nt, synthetic construct
  misc_feature 1..39: note = derived and/or modified sequence opt2 from anti-HIV_CDR
  source 1..39: mol_type = other RNA
gaccgccgcgacgacgaccgcgcctggctcctcgacccc

SEQ ID NO: 21429 - RNA, 39 nt, synthetic construct
  misc_feature 1..39: note = derived and/or modified sequence opt2 from anti-HIV_CDR
  source 1..39: mol_type = other RNA
gacggctccggcgacgcccgcgactggcacctcgacccc

SEQ ID NO: 21430 - RNA, 39 nt, synthetic construct
  misc_feature 1..39: note = derived and/or modified sequence opt2 from anti-HIV_CDR
  source 1..39: mol_type = other RNA
gacggctccggcgacgccacctcctggcacctccacccc

SEQ ID NO: 21431 - RNA, 39 nt, synthetic construct
  misc_feature 1..39: note = derived and/or modified sequence opt2 from anti-HIV_CDR
  source 1..39: mol_type = other RNA
gacgagtccggcgacgacctcaagtggcacctccacccc

SEQ ID NO: 21432 - RNA, 39 nt, synthetic construct
  misc_feature 1..39: note = derived and/or modified sequence opt2 from anti-HIV_CDR
  source 1..39: mol_type = other RNA
gacggctccggcgacgacacctcctggcacctccacccc

SEQ ID NO: 21433 - RNA, 39 nt, synthetic construct
  misc_feature 1..39: note = derived and/or modified sequence opt2 from anti-HIV_CDR
  source 1..39: mol_type = other RNA
gcccagggcgacatcctcaccgagggctacttcgactac

SEQ ID NO: 21434 - RNA, 39 nt, synthetic construct
  misc_feature 1..39: note = derived and/or modified sequence opt2 from anti-HIV_CDR
  source 1..39: mol_type = other RNA
gaccgcatgttctggcagcagctcgccaagtacgactcc

SEQ ID NO: 21435 - RNA, 39 nt, synthetic construct
  misc_feature 1..39: note = derived and/or modified sequence opt2 from anti-HIV_CDR
  source 1..39: mol_type = other RNA
tccacctgggactactccctctccgcccacgaggacgtc

SEQ ID NO: 21436 - RNA, 39 nt, synthetic construct
  misc_feature 1..39: note = derived and/or modified sequence opt2 from anti-HIV_CDR
  source 1..39: mol_type = other RNA
gccgcctgggacgactccctctccggcctcaactgggtc

SEQ ID NO: 21437 - RNA, 39 nt, synthetic construct
  misc_feature 1..39: note = derived and/or modified sequence opt2 from anti-HIV_CDR
  source 1..39: mol_type = other RNA
ctctcctccgaccgcatcgtcgtcgtcggccccgactac

SEQ ID NO: 21438 - RNA, 39 nt, synthetic construct
  misc_feature 1..39: note = derived and/or modified sequence opt2 from anti-HIV_CDR
  source 1..39: mol_type = other RNA
gaggccggctccgtcaccgccaccggccccttcgactcc

SEQ ID NO: 21439 - RNA, 39 nt, synthetic construct
  misc_feature 1..39: note = derived and/or modified sequence opt2 from anti-HIV_CDR
  source 1..39: mol_type = other RNA
gacttcggccgcgcctacgccatcggctacttcgagtac

SEQ ID NO: 21440 - RNA, 39 nt, synthetic construct
  misc_feature 1..39: note = derived and/or modified sequence opt2 from anti-HIV_CDR
  source 1..39: mol_type = other RNA
gaccgcgccccctacggcgccttcgagcccttcgacttc

SEQ ID NO: 21441 - RNA, 39 nt, synthetic construct
  misc_feature 1..39: note = derived and/or modified sequence opt2 from anti-HIV_CDR
  source 1..39: mol_type = other RNA
aacggccactcctccctcggcggcggctacttcccccac

SEQ ID NO: 21442 - RNA, 39 nt, synthetic construct
  misc_feature 1..39: note = derived and/or modified sequence opt2 from anti-HIV_CDR
  source 1..39: mol_type = other RNA
aacggccactccgccctcggcggcgagtacttccagcac

SEQ ID NO: 21443 - RNA, 39 nt, synthetic construct
  misc_feature 1..39: note = derived and/or modified sequence opt2 from anti-HIV_CDR
  source 1..39: mol_type = other RNA
gccgcccgccgcgccttctactactactacatggacgtc

SEQ ID NO: 21444 - RNA, 39 nt, synthetic construct
  misc_feature 1..39: note = derived and/or modified sequence opt2 from anti-HIV_CDR
  source 1..39: mol_type = other RNA
gccaactactacgactcctccggctacggcctcgacatc

SEQ ID NO: 21445 - RNA, 39 nt, synthetic construct
  misc_feature 1..39: note = derived and/or modified sequence opt2 from anti-HIV_CDR
  source 1..39: mol_type = other RNA
cactcccgccccggcgcccccccccactacttcgactac

SEQ ID NO: 21446 - RNA, 39 nt, synthetic construct
  misc_feature 1..39: note = derived and/or modified sequence opt2 from anti-HIV_CDR
  source 1..39: mol_type = other RNA
ggcctcaccgtcgccaccctctacgacgccttcgacgtc

SEQ ID NO: 21447 - RNA, 39 nt, synthetic construct
  misc_feature 1..39: note = derived and/or modified sequence opt2 from anti-HIV_CDR
  source 1..39: mol_type = other RNA
cgcgaccgctacaactggaagtactactacctcgacgtc

SEQ ID NO: 21448 - RNA, 39 nt, synthetic construct
  misc_feature 1..39: note = derived and/or modified sequence opt2 from anti-HIV_CDR
  source 1..39: mol_type = other RNA
gaccgcggctcctccggctggtacggctggctcgacccc

SEQ ID NO: 21449 - RNA, 39 nt, synthetic construct
  misc_feature 1..39: note = derived and/or modified sequence opt2 from anti-HIV_CDR
  source 1..39: mol_type = other RNA
gaccgcctctcctccttctggtccggcggcatcgaccag

SEQ ID NO: 21450 - RNA, 39 nt, synthetic construct
  misc_feature 1..39: note = derived and/or modified sequence opt2 from anti-HIV_CDR
  source 1..39: mol_type = other RNA
gacgtcatcgtcggcgccctcctcggcgccttcgacatc

SEQ ID NO: 21451 - RNA, 39 nt, synthetic construct
  misc_feature 1..39: note = derived and/or modified sequence opt2 from anti-HIV_CDR
  source 1..39: mol_type = other RNA
cacctcatcgcccccaccgccggcaactacttctacccc

SEQ ID NO: 21452 - RNA, 39 nt, synthetic construct
  misc_feature 1..39: note = derived and/or modified sequence opt2 from anti-HIV_CDR
  source 1..39: mol_type = other RNA
gactcccgcccccaggccctcgtcgccgccctcgacgtc

SEQ ID NO: 21453 - RNA, 39 nt, synthetic construct
  misc_feature 1..39: note = derived and/or modified sequence opt2 from anti-HIV_CDR
  source 1..39: mol_type = other RNA
gacgagatcgtcggcgccctcctcggcgccttcgacatc

SEQ ID NO: 21454 - RNA, 39 nt, synthetic construct
  misc_feature 1..39: note = derived and/or modified sequence opt2 from anti-HIV_CDR
  source 1..39: mol_type = other RNA
tccgaccccgccatcgccgccgccggctccctcgacctc

SEQ ID NO: 21455 - RNA, 39 nt, synthetic construct
  misc_feature 1..39: note = derived and/or modified sequence opt2 from anti-HIV_CDR
  source 1..39: mol_type = other RNA
ccctacgtccagaccgtcgccaccaccaccttcgacttc

SEQ ID NO: 21456 - RNA, 39 nt, synthetic construct
  misc_feature 1..39: note = derived and/or modified sequence opt2 from anti-HIV_CDR
  source 1..39: mol_type = other RNA
ggccccaagtccgtcgcctccctctcctacttcgacaag

SEQ ID NO: 21457 - RNA, 39 nt, synthetic construct
  misc_feature 1..39: note = derived and/or modified sequence opt2 from anti-HIV_CDR
  source 1..39: mol_type = other RNA
ggcgccctctggttcggccagctccgcggcctcgacccc

SEQ ID NO: 21458 - RNA, 39 nt, synthetic construct
  misc_feature 1..39: note = derived and/or modified sequence opt2 from anti-HIV_CDR
  source 1..39: mol_type = other RNA
gacctccgccccatgcgcggcaactgggccatgcacgtc

SEQ ID NO: 21459 - RNA, 39 nt, synthetic construct
  misc_feature 1..39: note = derived and/or modified sequence opt2 from anti-HIV_CDR
  source 1..39: mol_type = other RNA
gacccccaggtcaaccgccgcggcaactgcttcgaccac

SEQ ID NO: 21460 - RNA, 39 nt, synthetic construct; identical to SEQ ID NO: 13818
  misc_feature 1..39: note = derived and/or modified sequence opt2 from anti-HIV_CDR
  source 1..39: mol_type = other RNA

SEQ ID NO: 21461 - RNA, 39 nt, synthetic construct
  misc_feature 1..39: note = derived and/or modified sequence opt2 from anti-HIV_CDR
  source 1..39: mol_type = other RNA
gtcccccgcaccaccgccacccgcaacgccttcgacatc

SEQ ID NO: 21462 - RNA, 39 nt, synthetic construct
  misc_feature 1..39: note = derived and/or modified sequence opt2 from anti-HIV_CDR
  source 1..39: mol_type = other RNA
cacaagtccgtcctcctctggttccgcgagctcgactac

SEQ ID NO: 21463 - RNA, 39 nt, synthetic construct
  misc_feature 1..39: note = derived and/or modified sequence opt2 from anti-HIV_CDR
  source 1..39: mol_type = other RNA
gactccgaggactacgtcgactactactacatggacgtc

SEQ ID NO: 21464 - RNA, 39 nt, synthetic construct
  misc_feature 1..39: note = derived and/or modified sequence opt2 from anti-HIV_CDR
  source 1..39: mol_type = other RNA
ctcccccgcaccaccggcatccgcaacgccttcgacatc

SEQ ID NO: 21465 - RNA, 39 nt, synthetic construct
  misc_feature 1..39: note = derived and/or modified sequence opt2 from anti-HIV_CDR
  source 1..39: mol_type = other RNA
ctcccccgcaccaccggcatccgcaacgccttcgacttc

SEQ ID NO: 21466 - RNA, 42 nt, synthetic construct
  misc_feature 1..42: note = derived and/or modified sequence opt2 from anti-HIV_CDR
  source 1..42: mol_type = other RNA
ggcaccctctggttcggcgagtccggcctccgcctcgaccac

SEQ ID NO: 21467 - RNA, 42 nt, synthetic construct
  misc_feature 1..42: note = derived and/or modified sequence opt2 from anti-HIV_CDR
  source 1..42: mol_type = other RNA
gtcgcctacgtccacgtcgtcaccacccgctccctcgacaac

SEQ ID NO: 21468 - RNA, 42 nt, synthetic construct
  misc_feature 1..42: note = derived and/or modified sequence opt2 from anti-HIV_CDR
  source 1..42: mol_type = other RNA
gccgactacgacctcctcacctcctcctaccacttcgactcc

SEQ ID NO: 21469 - RNA, 42 nt, synthetic construct
  misc_feature 1..42: note = derived and/or modified sequence opt2 from anti-HIV_CDR
  source 1..42: mol_type = other RNA
acccgctgcttcggcgccaactgcttcaacttcatggacgtc

SEQ ID NO: 21470 - RNA, 42 nt, synthetic construct
  misc_feature 1..42: note = derived and/or modified sequence opt2 from anti-HIV_CDR
  source 1..42: mol_type = other RNA
ggcggcctctactgctcctccatctcctgcatcatggacgtc

SEQ ID NO: 21471 - RNA, 42 nt, synthetic construct
  misc_feature 1..42: note = derived and/or modified sequence opt2 from anti-HIV_CDR
  source 1..42: mol_type = other RNA
aacgagccccagtaccactccctccccggcatgttcgactac

SEQ ID NO: 21472 - RNA, 42 nt, synthetic construct
  misc_feature 1..42: note = derived and/or modified sequence opt2 from anti-HIV_CDR
  source 1..42: mol_type = other RNA
gagccccgcgagatgggcaccctcaccgccggcttcgagtac

SEQ ID NO: 21473 - RNA, 42 nt, synthetic construct
  misc_feature 1..42: note = derived and/or modified sequence opt2 from anti-HIV_CDR
  source 1..42: mol_type = other RNA
gccaccggctactcctacggctacctcgacgccttcgacatc

SEQ ID NO: 21474 - RNA, 42 nt, synthetic construct
  misc_feature 1..42: note = derived and/or modified sequence opt2 from anti-HIV_CDR
  source 1..42: mol_type = other RNA
ggctccctctggttcggcgagtccggcctccgcctcgaccac

SEQ ID NO: 21475 - RNA, 42 nt, synthetic construct
  misc_feature 1..42: note = derived and/or modified sequence opt2 from anti-HIV_CDR
  source 1..42: mol_type = other RNA
gacaacaccatctccggcgtcgtcccccgctggttcgactac

SEQ ID NO: 21476 - RNA, 42 nt, synthetic construct
  misc_feature 1..42: note = derived and/or modified sequence opt2 from anti-HIV_CDR
  source 1..42: mol_type = other RNA
atctacgacggccgcggctactactcctacttcttcgacctc

SEQ ID NO: 21477 - RNA, 42 nt, synthetic construct
  misc_feature 1..42: note = derived and/or modified sequence opt2 from anti-HIV_CDR
  source 1..42: mol_type = other RNA
gaccgcttcaactggaacgacggcggctacttcttcgactcc

SEQ ID NO: 21478 - RNA, 42 nt, synthetic construct
  misc_feature 1..42: note = derived and/or modified sequence opt2 from anti-HIV_CDR
  source 1..42: mol_type = other RNA
ggccactcctcctcctggaccaagttcaactggttcggcccc

SEQ ID NO: 21479 - RNA, 42 nt, synthetic construct
  misc_feature 1..42: note = derived and/or modified sequence opt2 from anti-HIV_CDR
  source 1..42: mol_type = other RNA
tccatcgccgccgacgactactactactactacatggacgtc

SEQ ID NO: 21480 - RNA, 42 nt, synthetic construct
  misc_feature 1..42: note = derived and/or modified sequence opt2 from anti-HIV_CDR
  source 1..42: mol_type = other RNA
tccttctacgacaacggcggctactacctcggcctcgactac

SEQ ID NO: 21481 - RNA, 42 nt, synthetic construct
  misc_feature 1..42: note = derived and/or modified sequence opt2 from anti-HIV_CDR
  source 1..42: mol_type = other RNA
gacaaggacgcctccatctacggctaccgcatcctcaaccac

SEQ ID NO: 21482 - RNA, 42 nt, synthetic construct
  misc_feature 1..42: note = derived and/or modified sequence opt2 from anti-HIV_CDR
  source 1..42: mol_type = other RNA
gtcctcaccgacctcgaccagggcaacccccgcatggacgtc

SEQ ID NO: 21483 - RNA, 42 nt, synthetic construct
  misc_feature 1..42: note = derived and/or modified sequence opt2 from anti-HIV_CDR
  source 1..42: mol_type = other RNA
cgcgagatcaagttcggcgagctctccttctacttcgactcc

SEQ ID NO: 21484 - RNA, 42 nt, synthetic construct
  misc_feature 1..42: note = derived and/or modified sequence opt2 from anti-HIV_CDR
  source 1..42: mol_type = other RNA
cgcgagatccgcttcggcgagctctccttctacttcgactac

SEQ ID NO: 21485 - RNA, 42 nt, synthetic construct
  misc_feature 1..42: note = derived and/or modified sequence opt2 from anti-HIV_CDR
  source 1..42: mol_type = other RNA
ccccactcccccaccaacatcccctcccgccccctcgactac

SEQ ID NO: 21486 - RNA, 42 nt, synthetic construct
  misc_feature 1..42: note = derived and/or modified sequence opt2 from anti-HIV_CDR
  source 1..42: mol_type = other RNA
ggcgactacgacatcctcacctcctcctaccagttcgactac

SEQ ID NO: 21487 - RNA, 42 nt, synthetic construct
  misc_feature 1..42: note = derived and/or modified sequence opt2 from anti-HIV_CDR
  source 1..42: mol_type = other RNA
tccacccccctcgtctggccccccgccaacggcctcgacgtc

SEQ ID NO: 21488 - RNA, 42 nt, synthetic construct
  misc_feature 1..42: note = derived and/or modified sequence opt2 from anti-HIV_CDR
  source 1..42: mol_type = other RNA
acccgcaacaccggcaactccctcccctactggttcgacctc

SEQ ID NO: 21489 - RNA, 45 nt, synthetic construct
  misc_feature 1..45: note = derived and/or modified sequence opt2 from anti-HIV_CDR
  source 1..45: mol_type = other RNA
gagaagggccagtggctcaccgtccccccctactacttcgactcc

SEQ ID NO: 21490 - RNA, 45 nt, synthetic construct
  misc_feature 1..45: note = derived and/or modified sequence opt2 from anti-HIV_CDR
  source 1..45: mol_type = other RNA
ggctccggccgctggaccatcggcgcccgcatctacttcgacaac

SEQ ID NO: 21491 - RNA, 45 nt, synthetic construct
  misc_feature 1..45: note = derived and/or modified sequence opt2 from anti-HIV_CDR
  source 1..45: mol_type = other RNA
ctcgaggccgacggcgccgactactcccccaagatgttcgacttc

SEQ ID NO: 21492 - RNA, 45 nt, synthetic construct
  misc_feature 1..45: note = derived and/or modified sequence opt2 from anti-HIV_CDR
  source 1..45: mol_type = other RNA
ctcgaggccgacggcggcgactactcccccaagatgttcgactac

SEQ ID NO: 21493 - RNA, 45 nt, synthetic construct
  misc_feature 1..45: note = derived and/or modified sequence opt2 from anti-HIV_CDR
  source 1..45: mol_type = other RNA
ctcgaggccgacggcgacaactactcccccaagatggtcgactac

SEQ ID NO: 21494 - RNA, 45 nt, synthetic construct
  misc_feature 1..45: note = derived and/or modified sequence opt2 from anti-HIV_CDR
  source 1..45: mol_type = other RNA
ctcgaggccgacggcgacgactactcccccaagatgttcgactac

SEQ ID NO: 21495 - RNA, 45 nt, synthetic construct
  misc_feature 1..45: note = derived and/or modified sequence opt2 from anti-HIV_CDR
  source 1..45: mol_type = other RNA
ctcgaggccgacggctccgactactcccccaagatgttcgacttc

SEQ ID NO: 21496 - RNA, 45 nt, synthetic construct
  misc_feature 1..45: note = derived and/or modified sequence opt2 from anti-HIV_CDR
  source 1..45: mol_type = other RNA
ctcgaggccgacggcgacgactactcccccaagatgttcgaccac

SEQ ID NO: 21497 - RNA, 45 nt, synthetic construct
  misc_feature 1..45: note = derived and/or modified sequence opt2 from anti-HIV_CDR
  source 1..45: mol_type = other RNA
ctcgaggccgacggcgacgactactcccccaagatggtcgactac

SEQ ID NO: 21498 - RNA, 45 nt, synthetic construct
  misc_feature 1..45: note = derived and/or modified sequence opt2 from anti-HIV_CDR
  source 1..45: mol_type = other RNA
gccccccgcctcgacctcggcgagctctcctccggcttccacttc

SEQ ID NO: 21499 - RNA, 45 nt, synthetic construct
  misc_feature 1..45: note = derived and/or modified sequence opt2 from anti-HIV_CDR
  source 1..45: mol_type = other RNA
gccccccgcctcgagctcggcgagctctcctccggcttccactac

SEQ ID NO: 21500 - RNA, 45 nt, synthetic construct
  misc_feature 1..45: note = derived and/or modified sequence opt2 from anti-HIV_CDR
  source 1..45: mol_type = other RNA
ggccgcctcctcatgcagtggcccccccgcggcggcttcgacccc

SEQ ID NO: 21501 - RNA, 45 nt, synthetic construct
  misc_feature 1..45: note = derived and/or modified sequence opt2 from anti-HIV_CDR
  source 1..45: mol_type = other RNA
ggccgcctcttcatgcagtggcccccccgcggcggcttcgacccc

SEQ ID NO: 21502 - RNA, 45 nt, synthetic construct
  misc_feature 1..45: note = derived and/or modified sequence opt2 from anti-HIV_CDR
  source 1..45: mol_type = other RNA
ggccgcctcttcgtccagtggcccccccagggcggcttcgacccc

SEQ ID NO: 21503 - RNA, 45 nt, synthetic construct
  misc_feature 1..45: note = derived and/or modified sequence opt2 from anti-HIV_CDR
  source 1..45: mol_type = other RNA
ggccgcctcttcatgcagtggcccccccagggcggcttcgacccc

SEQ ID NO: 21504 - RNA, 45 nt, synthetic construct
  misc_feature 1..45: note = derived and/or modified sequence opt2 from anti-HIV_CDR
  source 1..45: mol_type = other RNA
ggccgcctcttcgtccagtggcccccccagggcggcttcgacacc

SEQ ID NO: 21505 - RNA, 45 nt, synthetic construct
  misc_feature 1..45: note = derived and/or modified sequence opt2 from anti-HIV_CDR
  source 1..45: mol_type = other RNA
aacaacaacacccgcaagtccatcaacatcggccccggccgcgcc

SEQ ID NO: 21506 - RNA, 45 nt, synthetic construct; identical to SEQ ID NO: 13864
  misc_feature 1..45: note = derived and/or modified sequence opt2 from anti-HIV_CDR
  source 1..45: mol_type = other RNA

SEQ ID NO: 21507 - RNA, 45 nt, synthetic construct
  misc_feature 1..45: note = derived and/or modified sequence opt2 from anti-HIV_CDR
  source 1..45: mol_type = other RNA
gacctcctccccgactaccccgtctcctccgcccccgaggacttc

SEQ ID NO: 21508 - RNA, 45 nt, synthetic construct
  misc_feature 1..45: note = derived and/or modified sequence opt2 from anti-HIV_CDR
  source 1..45: mol_type = other RNA
gagtcctggctctactccaacggcgactactactacatggacgtc

SEQ ID NO: 21509 - RNA, 45 nt, synthetic construct
  misc_feature 1..45: note = derived and/or modified sequence opt2 from anti-HIV_CDR
  source 1..45: mol_type = other RNA
cgctactgctcctccaccacctgctaccgcggccacttcgactac

SEQ ID NO: 21510 - RNA, 45 nt, synthetic construct
  misc_feature 1..45: note = derived and/or modified sequence opt2 from anti-HIV_CDR
  source 1..45: mol_type = other RNA
cagaccaccgacgagggccgccagtggctcgtcggcttccagcac

SEQ ID NO: 21511 - RNA, 45 nt, synthetic construct
  misc_feature 1..45: note = derived and/or modified sequence opt2 from anti-HIV_CDR
  source 1..45: mol_type = other RNA
ccctcctacggcggctacgacgaccagggctggtacttcgagtac

SEQ ID NO: 21512 - RNA, 45 nt, synthetic construct
  misc_feature 1..45: note = derived and/or modified sequence opt2 from anti-HIV_CDR
  source 1..45: mol_type = other RNA
gccgccatccccatcggcgactccaagtactcctacttcgactcc

SEQ ID NO: 21513 - RNA, 45 nt, synthetic construct
  misc_feature 1..45: note = derived and/or modified sequence opt2 from anti-HIV_CDR
  source 1..45: mol_type = other RNA
gcccccccccccggctccaccgagtgggcctactacttcgactac

SEQ ID NO: 21514 - RNA, 45 nt, synthetic construct
  misc_feature 1..45: note = derived and/or modified sequence opt2 from anti-HIV_CDR
  source 1..45: mol_type = other RNA
gcccagttccacaactccggctactactactccggcctcgactac

SEQ ID NO: 21515 - RNA, 45 nt, synthetic construct
  misc_feature 1..45: note = derived and/or modified sequence opt2 from anti-HIV_CDR
  source 1..45: mol_type = other RNA
ggcggctacgactacggcgaccactactactactacatggacgtc

SEQ ID NO: 21516 - RNA, 45 nt, synthetic construct
  misc_feature 1..45: note = derived and/or modified sequence opt2 from anti-HIV_CDR
  source 1..45: mol_type = other RNA
ggcacccagtcctactccgccgtcgcccccggctggttcgacccc

SEQ ID NO: 21517 - RNA, 45 nt, synthetic construct
  misc_feature 1..45: note = derived and/or modified sequence opt2 from anti-HIV_CDR
  source 1..45: mol_type = other RNA
atcaagggccccccccgcggcaacttcggcgtcgccttctacttc

SEQ ID NO: 21518 - RNA, 45 nt, synthetic construct
  misc_feature 1..45: note = derived and/or modified sequence opt2 from anti-HIV_CDR
  source 1..45: mol_type = other RNA
aaggtctactccgacggctggtccccccccaccggcttcgtctac

SEQ ID NO: 21519 - RNA, 45 nt, synthetic construct
  misc_feature 1..45: note = derived and/or modified sequence opt2 from anti-HIV_CDR
  source 1..45: mol_type = other RNA
cgctacaagtacctccccggcgaccagcacatgccctgggacaac

SEQ ID NO: 21520 - RNA, 45 nt, synthetic construct
  misc_feature 1..45: note = derived and/or modified sequence opt2 from anti-HIV_CDR
  source 1..45: mol_type = other RNA
cgctacaagtacctccccggcgaccagcacatgccctgggactac

SEQ ID NO: 21521 - RNA, 45 nt, synthetic construct
  misc_feature 1..45: note = derived and/or modified sequence opt2 from anti-HIV_CDR
  source 1..45: mol_type = other RNA
ggcggcggctacgccgtcgtcggccccaagtacggcctcgacgtc

SEQ ID NO: 21522 - RNA, 45 nt, synthetic construct
  misc_feature 1..45: note = derived and/or modified sequence opt2 from anti-HIV_CDR
  source 1..45: mol_type = other RNA
ctcgactcctcctccggctgggaggaggtcggctacttcgaccgc

SEQ ID NO: 21523 - RNA, 45 nt, synthetic construct
  misc_feature 1..45: note = derived and/or modified sequence opt2 from anti-HIV_CDR
  source 1..45: mol_type = other RNA
gagaactactccgacggctgggaggaggtcggccacttcgactac

SEQ ID NO: 21524 - RNA, 45 nt, synthetic construct
  misc_feature 1..45: note = derived and/or modified sequence opt2 from anti-HIV_CDR
  source 1..45: mol_type = other RNA
gagaactactccgacggctgggaggaggtcggccacttcgactcc

SEQ ID NO: 21525 - RNA, 45 nt, synthetic construct
  misc_feature 1..45: note = derived and/or modified sequence opt2 from anti-HIV_CDR
  source 1..45: mol_type = other RNA
gagaactactccgacggctggaacgaggtcggccacttcgacttc

SEQ ID NO: 21526 - RNA, 45 nt, synthetic construct
  misc_feature 1..45: note = derived and/or modified sequence opt2 from anti-HIV_CDR
  source 1..45: mol_type = other RNA
gagaactactccgacggctggtacgaggtcggccacttcgacctc

SEQ ID NO: 21527 - RNA, 45 nt, synthetic construct
  misc_feature 1..45: note = derived and/or modified sequence opt2 from anti-HIV_CDR
  source 1..45: mol_type = other RNA
gaccgccgccgcttcctcgagtggtccctctacggcatggacgtc

SEQ ID NO: 21528 - RNA, 45 nt, synthetic construct
  misc_feature 1..45: note = derived and/or modified sequence opt2 from anti-HIV_CDR
  source 1..45: mol_type = other RNA
ggcccccgcgtcttcttcgagtcctccggctactacttccgcgac

SEQ ID NO: 21529 - RNA, 45 nt, synthetic construct
  misc_feature 1..45: note = derived and/or modified sequence opt2 from anti-HIV_CDR
  source 1..45: mol_type = other RNA
ggcccccgcgtcctcttcgagtcctccggccactacctccgcgac

SEQ ID NO: 21530 - RNA, 45 nt, synthetic construct
  misc_feature 1..45: note = derived and/or modified sequence opt2 from anti-HIV_CDR
  source 1..45: mol_type = other RNA
ggcccccgcgtcttcttcgagtcctccggctactacttccgcaac

SEQ ID NO: 21531 - RNA, 45 nt, synthetic construct
  misc_feature 1..45: note = derived and/or modified sequence opt2 from anti-HIV_CDR
  source 1..45: mol_type = other RNA
gagggcggctccctctggttcggcggcgccaactggctcgacccc

SEQ ID NO: 21532 - RNA, 45 nt, synthetic construct
  misc_feature 1..45: note = derived and/or modified sequence opt2 from anti-HIV_CDR
  source 1..45: mol_type = other RNA
gccgactacgacaacatctgggactcccgcggcggcttcgacctc

SEQ ID NO: 21533 - RNA, 45 nt, synthetic construct
  misc_feature 1..45: note = derived and/or modified sequence opt2 from anti-HIV_CDR
  source 1..45: mol_type = other RNA
gtcggcggcaccgtctggtccggctactccaactacctcgactac

SEQ ID NO: 21534 - RNA, 45 nt, synthetic construct
  misc_feature 1..45: note = derived and/or modified sequence opt2 from anti-HIV_CDR
  source 1..45: mol_type = other RNA
gacaaccgcgaccagtggctcgtcctccgctcctggttcgacccc

SEQ ID NO: 21535 - RNA, 45 nt, synthetic construct
  misc_feature 1..45: note = derived and/or modified sequence opt2 from anti-HIV_CDR
  source 1..45: mol_type = other RNA
gagaagggccagtgggtcaccctccccccctactacttcgactcc

SEQ ID NO: 21536 - RNA, 48 nt, synthetic construct
  misc_feature 1..48: note = derived and/or modified sequence opt2 from anti-HIV_CDR
  source 1..48: mol_type = other RNA
tacttctccgacaccgaccgctccgagtactccccctccctccgctcc

SEQ ID NO: 21537 - RNA, 48 nt, synthetic construct
  misc_feature 1..48: note = derived and/or modified sequence opt2 from anti-HIV_CDR
  source 1..48: mol_type = other RNA
tacatctccgaccgcgagtccgccacctacaacccctccctcaactcc

SEQ ID NO: 21538 - RNA, 48 nt, synthetic construct
  misc_feature 1..48: note = derived and/or modified sequence opt2 from anti-HIV_CDR
  source 1..48: mol_type = other RNA
tacttctccgacaccgagaagtccaactacaacccctccctccgctcc

SEQ ID NO: 21539 - RNA, 48 nt, synthetic construct
  misc_feature 1..48: note = derived and/or modified sequence opt2 from anti-HIV_CDR
  source 1..48: mol_type = other RNA
tacatctccgaccgcgcctccgccacctacaacccctccctcaactcc

SEQ ID NO: 21540 - RNA, 48 nt, synthetic construct
  misc_feature 1..48: note = derived and/or modified sequence opt2 from anti-HIV_CDR
  source 1..48: mol_type = other RNA
tacgtccaccactccggcgacaccaactacaacccctccctcaagcgc

SEQ ID NO: 21541 - RNA, 48 nt, synthetic construct
  misc_feature 1..48: note = derived and/or modified sequence opt2 from anti-HIV_CDR
  source 1..48: mol_type = other RNA
tacgtccacaagtccggcgacaccaactactccccctccctcaagtcc

SEQ ID NO: 21542 - RNA, 48 nt, synthetic construct
  misc_feature 1..48: note = derived and/or modified sequence opt2 from anti-HIV_CDR
  source 1..48: mol_type = other RNA
tacgtccacgactccggcgacaccaactacaacccctccctcaagtcc

SEQ ID NO: 21543 - RNA, 48 nt, synthetic construct
  misc_feature 1..48: note = derived and/or modified sequence opt2 from anti-HIV_CDR
  source 1..48: mol_type = other RNA
tacatctccaagtccgagtccgccaactacaacccctccctcaactcc

SEQ ID NO: 21544 - RNA, 48 nt, synthetic construct
  misc_feature 1..48: note = derived and/or modified sequence opt2 from anti-HIV_CDR
  source 1..48: mol_type = other RNA
tacatctactactccggctccaccaactacaacccctccctcaagtcc

SEQ ID NO: 21545 - RNA, 48 nt, synthetic construct
  misc_feature 1..48: note = derived and/or modified sequence opt2 from anti-HIV_CDR
  source 1..48: mol_type = other RNA
tacgtccacgactccggcgacatcaactacaacccctccctcaagaac

SEQ ID NO: 21546 - RNA, 48 nt, synthetic construct
  misc_feature 1..48: note = derived and/or modified sequence opt2 from anti-HIV_CDR
  source 1..48: mol_type = other RNA
tcctactacgacttctccatcggcgacggcaacgacgccttcgacgtc

SEQ ID NO: 21547 - RNA, 48 nt, synthetic construct
  misc_feature 1..48: note = derived and/or modified sequence opt2 from anti-HIV_CDR
  source 1..48: mol_type = other RNA
ggcttccgcggctcccccttctcctccggctccctctacttcgactcc

SEQ ID NO: 21548 - RNA, 48 nt, synthetic construct
  misc_feature 1..48: note = derived and/or modified sequence opt2 from anti-HIV_CDR
  source 1..48: mol_type = other RNA
gtcatctccggccgcatcaccatcttctactacaactacatcgacgtc

SEQ ID NO: 21549 - RNA, 48 nt, synthetic construct
  misc_feature 1..48: note = derived and/or modified sequence opt2 from anti-HIV_CDR
  source 1..48: mol_type = other RNA
gacggcctcggcgaggtcgcccccgactaccgctacggcatcgacgtc

SEQ ID NO: 21550 - RNA, 48 nt, synthetic construct
  misc_feature 1..48: note = derived and/or modified sequence opt2 from anti-HIV_CDR
  source 1..48: mol_type = other RNA
gacggcctcggcgagctcgcccccgcctaccagtacggcatcgacgtc

SEQ ID NO: 21551 - RNA, 48 nt, synthetic construct
  misc_feature 1..48: note = derived and/or modified sequence opt2 from anti-HIV_CDR
  source 1..48: mol_type = other RNA
gacggcctcggcgagctcgcccccgcctaccactacggcatcgacgtc

SEQ ID NO: 21552 - RNA, 48 nt, synthetic construct
  misc_feature 1..48: note = derived and/or modified sequence opt2 from anti-HIV_CDR
  source 1..48: mol_type = other RNA
gacggcctcggcgaggtcgcccccgcctacctctacggcatcgacgcc

SEQ ID NO: 21553 - RNA, 48 nt, synthetic construct
  misc_feature 1..48: note = derived and/or modified sequence opt2 from anti-HIV_CDR
  source 1..48: mol_type = other RNA
gccgtcaagggcttctggttcgacgaggtctacaactggttcggcccc

SEQ ID NO: 21554 - RNA, 48 nt, synthetic construct
  misc_feature 1..48: note = derived and/or modified sequence opt2 from anti-HIV_CDR
  source 1..48: mol_type = other RNA
gccgtcaagggcttctggttcgacgacccctacacctggttcggcccc

SEQ ID NO: 21555 - RNA, 48 nt, synthetic construct
  misc_feature 1..48: note = derived and/or modified sequence opt2 from anti-HIV_CDR
  source 1..48: mol_type = other RNA
gccgtcaagggcttctggttcgacgagccctccacctggttcggcccc

SEQ ID NO: 21556 - RNA, 48 nt, synthetic construct
  misc_feature 1..48: note = derived and/or modified sequence opt2 from anti-HIV_CDR
  source 1..48: mol_type = other RNA
gccgtcaagggcctctggttcgacgagacctacacctggttcggcccc

SEQ ID NO: 21557 - RNA, 48 nt, synthetic construct
  misc_feature 1..48: note = derived and/or modified sequence opt2 from anti-HIV_CDR
  source 1..48: mol_type = other RNA
gccgtcgccggcctctggttcgaggacgcctacaactggttcggcccc

SEQ ID NO: 21558 - RNA, 48 nt, synthetic construct
  misc_feature 1..48: note = derived and/or modified sequence opt2 from anti-HIV_CDR
  source 1..48: mol_type = other RNA
gccgaggccgagtcccagtcccactcccgccccatcatgttcgactac

SEQ ID NO: 21559 - RNA, 48 nt, synthetic construct
  misc_feature 1..48: note = derived and/or modified sequence opt2 from anti-HIV_CDR
  source 1..48: mol_type = other RNA
gccgaggccgcctccgactcccactcccgccccatcatgttcgaccac

SEQ ID NO: 21560 - RNA, 48 nt, synthetic construct
  misc_feature 1..48: note = derived and/or modified sequence opt2 from anti-HIV_CDR
  source 1..48: mol_type = other RNA
ctcgaggccgagtccgactcccactcccgccccatcatgttcgaccac

SEQ ID NO: 21561 - RNA, 48 nt, synthetic construct
  misc_feature 1..48: note = derived and/or modified sequence opt2 from anti-HIV_CDR
  source 1..48: mol_type = other RNA
gccgaggccgagtcccagtcccactcccgccccatcatgttcgactcc

SEQ ID NO: 21562 - RNA, 48 nt, synthetic construct
  misc_feature 1..48: note = derived and/or modified sequence opt2 from anti-HIV_CDR
  source 1..48: mol_type = other RNA
gccgaggccgagtcccagtcccactcccgccccatcatgttcgacttc

SEQ ID NO: 21563 - RNA, 48 nt, synthetic construct
  misc_feature 1..48: note = derived and/or modified sequence opt2 from anti-HIV_CDR
  source 1..48: mol_type = other RNA
gacaaccccctcctccagtccggcgagttctcctcctccctcgagaac

SEQ ID NO: 21564 - RNA, 48 nt, synthetic construct
  misc_feature 1..48: note = derived and/or modified sequence opt2 from anti-HIV_CDR
  source 1..48: mol_type = other RNA
gacaaccccctcctccagtccggcgagttctcctcctccctcgacaac

SEQ ID NO: 21565 - RNA, 48 nt, synthetic construct
  misc_feature 1..48: note = derived and/or modified sequence opt2 from anti-HIV_CDR
  source 1..48: mol_type = other RNA
ggccgcgactacaacttctggggcggcggcggcaagatcaacttcccc

SEQ ID NO: 21566 - RNA, 48 nt, synthetic construct
  misc_feature 1..48: note = derived and/or modified sequence opt2 from anti-HIV_CDR
  source 1..48: mol_type = other RNA
accaactgggccaacgacttcgtcaccggctactaccgcttcgacttc

SEQ ID NO: 21567 - RNA, 48 nt, synthetic construct
  misc_feature 1..48: note = derived and/or modified sequence opt2 from anti-HIV_CDR
  source 1..48: mol_type = other RNA
gccggccactgctcctccacctcctccgtctactgccccttcgacatg

SEQ ID NO: 21568 - RNA, 48 nt, synthetic construct
  misc_feature 1..48: note = derived and/or modified sequence opt2 from anti-HIV_CDR
  source 1..48: mol_type = other RNA
caggtctcctcctactcctcctccggctaccgccgcgagttcgactac

SEQ ID NO: 21569 - RNA, 48 nt, synthetic construct
  misc_feature 1..48: note = derived and/or modified sequence opt2 from anti-HIV_CDR
  source 1..48: mol_type = other RNA
cgcatggccaccctcaccggcggctactactactactacatggacgtc

SEQ ID NO: 21570 - RNA, 48 nt, synthetic construct
  misc_feature 1..48: note = derived and/or modified sequence opt2 from anti-HIV_CDR
  source 1..48: mol_type = other RNA
gagggcggctactccgacttctggtccggctactccggcttcgactac

SEQ ID NO: 21571 - RNA, 48 nt, synthetic construct
  misc_feature 1..48: note = derived and/or modified sequence opt2 from anti-HIV_CDR
  source 1..48: mol_type = other RNA
ctctactacaacttcggctccggctacgacaccggcatcggcgaccac

SEQ ID NO: 21572 - RNA, 48 nt, synthetic construct
  misc_feature 1..48: note = derived and/or modified sequence opt2 from anti-HIV_CDR
  source 1..48: mol_type = other RNA
gcccgcgagggccgctggttctccgacaactactacgccatggacgtc

SEQ ID NO: 21573 - RNA, 48 nt, synthetic construct
  misc_feature 1..48: note = derived and/or modified sequence opt2 from anti-HIV_CDR
  source 1..48: mol_type = other RNA
gaccgcgtcggccgccgcctcggcgagctctccgccggcttcgactac

SEQ ID NO: 21574 - RNA, 48 nt, synthetic construct
  misc_feature 1..48: note = derived and/or modified sequence opt2 from anti-HIV_CDR
  source 1..48: mol_type = other RNA
gcccgcccccgctccccctgggactccaccggctggtccgtcggctac

SEQ ID NO: 21575 - RNA, 48 nt, synthetic construct
  misc_feature 1..48: note = derived and/or modified sequence opt2 from anti-HIV_CDR
  source 1..48: mol_type = other RNA
tcctactacgacttccgctccgactccggcaacgacgccttcgacatc

SEQ ID NO: 21576 - RNA, 48 nt, synthetic construct
  misc_feature 1..48: note = derived and/or modified sequence opt2 from anti-HIV_CDR
  source 1..48: mol_type = other RNA
tcctactacgacttccagaccgactccggcaacgacgccttcgacgtc

SEQ ID NO: 21577 - RNA, 48 nt, synthetic construct
  misc_feature 1..48: note = derived and/or modified sequence opt2 from anti-HIV_CDR
  source 1..48: mol_type = other RNA
gacaaccccgtcctccagctcggcgagctctcctcctccctcgactac

SEQ ID NO: 21578 - RNA, 48 nt, synthetic construct
  misc_feature 1..48: note = derived and/or modified sequence opt2 from anti-HIV_CDR
  source 1..48: mol_type = other RNA
ggcttccgcggctcccccttctcctccggctccatgtacttcgactcc

SEQ ID NO: 21579 - RNA, 48 nt, synthetic construct
  misc_feature 1..48: note = derived and/or modified sequence opt2 from anti-HIV_CDR
  source 1..48: mol_type = other RNA
ggcttccgcggctcccccctctcctccggctccctctacttcgactcc

SEQ ID NO: 21580 - RNA, 48 nt, synthetic construct
  misc_feature 1..48: note = derived and/or modified sequence opt2 from anti-HIV_CDR
  source 1..48: mol_type = other RNA
ggcttccgcggcaacgtcttctccaccggctggttctacctcgacttc

SEQ ID NO: 21581 - RNA, 48 nt, synthetic construct
  misc_feature 1..48: note = derived and/or modified sequence opt2 from anti-HIV_CDR
  source 1..48: mol_type = other RNA
gaccgcctctccttctccgtccaggtcgagcagggcgtcctcgactac

SEQ ID NO: 21582 - RNA, 48 nt, synthetic construct
  misc_feature 1..48: note = derived and/or modified sequence opt2 from anti-HIV_CDR
  source 1..48: mol_type = other RNA
gaccgcctctccttctccgtccaggtcgagcagggcgtcctccagttc

SEQ ID NO: 21583 - RNA, 48 nt, synthetic construct
  misc_feature 1..48: note = derived and/or modified sequence opt2 from anti-HIV_CDR
  source 1..48: mol_type = other RNA
gtcctctccggccgcatcaccatcttctactactactacatggacgtc

SEQ ID NO: 21584 - RNA, 51 nt, synthetic construct
  misc_feature 1..51: note = derived and/or modified sequence opt2 from anti-HIV_CDR
  source 1..51: mol_type = other RNA
tacatctcctccggctcctccaccctccactacgccgacaccgtcaagggc

SEQ ID NO: 21585 - RNA, 51 nt, synthetic construct
  misc_feature 1..51: note = derived and/or modified sequence opt2 from anti-HIV_CDR
  source 1..51: mol_type = other RNA
cgctacctcgactggtcccccatcggccgcgacacctacggcaccgacgtc

SEQ ID NO: 21586 - RNA, 51 nt, synthetic construct
  misc_feature 1..51: note = derived and/or modified sequence opt2 from anti-HIV_CDR
  source 1..51: mol_type = other RNA
cgctacttcgactggtcccccttccgccgcgacacctacggcaccgacgtc

SEQ ID NO: 21587 - RNA, 51 nt, synthetic construct
  misc_feature 1..51: note = derived and/or modified sequence opt2 from anti-HIV_CDR
  source 1..51: mol_type = other RNA
ggccgcgactacaacttctggtccggcggcggccgctactacttcgacttc

SEQ ID NO: 21588 - RNA, 51 nt, synthetic construct
  misc_feature 1..51: note = derived and/or modified sequence opt2 from anti-HIV_CDR
  source 1..51: mol_type = other RNA
ggcatccaggaggactacgacttctggcgcgagtaccgcgagctcgactac

SEQ ID NO: 21589 - RNA, 51 nt, synthetic construct
  misc_feature 1..51: note = derived and/or modified sequence opt2 from anti-HIV_CDR
  source 1..51: mol_type = other RNA
gtcctcaacaacaacacccgcaagtccatcaacatcggccccggccgcgcc

SEQ ID NO: 21590 - RNA, 51 nt, synthetic construct
  misc_feature 1..51: note = derived and/or modified sequence opt2 from anti-HIV_CDR
  source 1..51: mol_type = other RNA
gacctcaacttcggcgtcgtcaccccctactactactactacctcgacgtc

SEQ ID NO: 21591 - RNA, 51 nt, synthetic construct
  misc_feature 1..51: note = derived and/or modified sequence opt2 from anti-HIV_CDR
  source 1..51: mol_type = other RNA
cacggccgcaccgtcttcggcgtcgtccgcaactactactacatggacgtc

SEQ ID NO: 21592 - RNA, 51 nt, synthetic construct
  misc_feature 1..51: note = derived and/or modified sequence opt2 from anti-HIV_CDR
  source 1..51: mol_type = other RNA
cactactacggctccggcctcaccaaggactactacgagtacatcgacgtc

SEQ ID NO: 21593 - RNA, 51 nt, synthetic construct
  misc_feature 1..51: note = derived and/or modified sequence opt2 from anti-HIV_CDR
  source 1..51: mol_type = other RNA
acctactacaacttctggtccgaccagtcccagggcctcgacttcgactac

SEQ ID NO: 21594 - RNA, 51 nt, synthetic construct
  misc_feature 1..51: note = derived and/or modified sequence opt2 from anti-HIV_CDR
  source 1..51: mol_type = other RNA
ggcgtctgggaggcccccgacggctcctcctactactactacatggccgac

SEQ ID NO: 21595 - RNA, 51 nt, synthetic construct
  misc_feature 1..51: note = derived and/or modified sequence opt2 from anti-HIV_CDR
  source 1..51: mol_type = other RNA
gaccagggcggctaccccgtctcccccgtcggccccaagtggttcgacccc

SEQ ID NO: 21596 - RNA, 51 nt, synthetic construct
  misc_feature 1..51: note = derived and/or modified sequence opt2 from anti-HIV_CDR
  source 1..51: mol_type = other RNA
cgcgacaagtaccagtacatcgactcctccggcgactaccccttcgaccgc

SEQ ID NO: 21597 - RNA, 51 nt, synthetic construct
  misc_feature 1..51: note = derived and/or modified sequence opt2 from anti-HIV_CDR
  source 1..51: mol_type = other RNA
cagctccgcgcccccaccacccgcttccgccacggcggctacttcgagaac

SEQ ID NO: 21598 - RNA, 51 nt, synthetic construct
  misc_feature 1..51: note = derived and/or modified sequence opt2 from anti-HIV_CDR
  source 1..51: mol_type = other RNA
caggtccgcgcccccaccctccgcttccgccacggcggctacttcgagacc

SEQ ID NO: 21599 - RNA, 51 nt, synthetic construct
  misc_feature 1..51: note = derived and/or modified sequence opt2 from anti-HIV_CDR
  source 1..51: mol_type = other RNA
gtctccatcacctacgccggcctcatcgtcgtccccggcgccttcgacgtc

SEQ ID NO: 21600 - RNA, 51 nt, synthetic construct
  misc_feature 1..51: note = derived and/or modified sequence opt2 from anti-HIV_CDR
  source 1..51: mol_type = other RNA
gtcgccatctcctacgccggcctcatcgtcgtccccggccccttcgacgtc

SEQ ID NO: 21601 - RNA, 51 nt, synthetic construct
  misc_feature 1..51: note = derived and/or modified sequence opt2 from anti-HIV_CDR
  source 1..51: mol_type = other RNA
tccctcaccggccgcctccacctcggcgagctctcctccggcatcggcccc

SEQ ID NO: 21602 - RNA, 51 nt, synthetic construct
  misc_feature 1..51: note = derived and/or modified sequence opt2 from anti-HIV_CDR
  source 1..51: mol_type = other RNA
ggcggctccgccctcatcaccatcttcggcgtcgaccccaagttcgacccc

SEQ ID NO: 21603 - RNA, 51 nt, synthetic construct
  misc_feature 1..51: note = derived and/or modified sequence opt2 from anti-HIV_CDR
  source 1..51: mol_type = other RNA
atggccctcacctccggcccctacgacgtctccggctactacttcgactac

SEQ ID NO: 21604 - RNA, 51 nt, synthetic construct
  misc_feature 1..51: note = derived and/or modified sequence opt2 from anti-HIV_CDR
  source 1..51: mol_type = other RNA
atggccctcgcctccggcccctacgacgtctccggctactacttcgactac

SEQ ID NO: 21605 - RNA, 51 nt, synthetic construct
  misc_feature 1..51: note = derived and/or modified sequence opt2 from anti-HIV_CDR
  source 1..51: mol_type = other RNA
atggccctcccctccggccccctcgaccgctccggctactacttcgacgac

SEQ ID NO: 21606 - RNA, 54 nt, synthetic construct
  misc_feature 1..54: note = derived and/or modified sequence opt2 from anti-HIV_CDR
  source 1..54: mol_type = other RNA
gtcgtccccatgttctccatcttcggcgtcgtcaaggccaactacttcgactac

SEQ ID NO: 21607 - RNA, 54 nt, synthetic construct
  misc_feature 1..54: note = derived and/or modified sequence opt2 from anti-HIV_CDR
  source 1..54: mol_type = other RNA
aaccgccgcgtcgccatgcccgaggccatgatcctctccttctacatggacgtc

SEQ ID NO: 21608 - RNA, 54 nt, synthetic construct
  misc_feature 1..54: note = derived and/or modified sequence opt2 from anti-HIV_CDR
  source 1..54: mol_type = other RNA
ggcctctgccgcggcggcaactgccgcctcggcccctccggctggctcgacccc

SEQ ID NO: 21609 - RNA, 54 nt, synthetic construct
  misc_feature 1..54: note = derived and/or modified sequence opt2 from anti-HIV_CDR
  source 1..54: mol_type = other RNA
acccccccccactacgacgtcctcaccggctacccctcctccgtcctcgagttc

SEQ ID NO: 21610 - RNA, 54 nt, synthetic construct
  misc_feature 1..54: note = derived and/or modified sequence opt2 from anti-HIV_CDR
  source 1..54: mol_type = other RNA
atcccctaccactccgagtcctactacaaggtcgtcatcggcggcttcgacgtc

SEQ ID NO: 21611 - RNA, 54 nt, synthetic construct
  misc_feature 1..54: note = derived and/or modified sequence opt2 from anti-HIV_CDR
  source 1..54: mol_type = other RNA
gccgaccccttcaaggtcgcccaggacgagggcctcttcgtcatcttcgactac

SEQ ID NO: 21612 - RNA, 54 nt, synthetic construct
  misc_feature 1..54: note = derived and/or modified sequence opt2 from anti-HIV_CDR
  source 1..54: mol_type = other RNA
gccgaccccttcaaggtcgcccaggacgagggcctctacgtcatcttcgactac

SEQ ID NO: 21613 - RNA, 54 nt, synthetic construct
  misc_feature 1..54: note = derived and/or modified sequence opt2 from anti-HIV_CDR
  source 1..54: mol_type = other RNA
gccgaccgcttcaaggtcgcccaggacgagggcctcttcgtcatcttcgactac

SEQ ID NO: 21614 - RNA, 54 nt, synthetic construct
  misc_feature 1..54: note = derived and/or modified sequence opt2 from anti-HIV_CDR
  source 1..54: mol_type = other RNA
ggccgccagaccttccgcgccatctggtccggcccccccgccgtcttcgacatc

SEQ ID NO: 21615 - RNA, 54 nt, synthetic construct
  misc_feature 1..54: note = derived and/or modified sequence opt2 from anti-HIV_CDR
  source 1..54: mol_type = other RNA
ggccgccagaccttccgcgccatctggtccggcccccccgtcgtcttcgacatc

SEQ ID NO: 21616 - RNA, 54 nt, synthetic construct
  misc_feature 1..54: note = derived and/or modified sequence opt2 from anti-HIV_CDR
  source 1..54: mol_type = other RNA
tcccgcggcgactacaacttctggtccggctaccccgagtaccacttcgaccgc

SEQ ID NO: 21617 - RNA, 54 nt, synthetic construct
  misc_feature 1..54: note = derived and/or modified sequence opt2 from anti-HIV_CDR
  source 1..54: mol_type = other RNA
ctccccaagtcccgcatggtcggcggcgaccacctccccttctaccccgacttc

SEQ ID NO: 21618 - RNA, 54 nt, synthetic construct
  misc_feature 1..54: note = derived and/or modified sequence opt2 from anti-HIV_CDR
  source 1..54: mol_type = other RNA
ctcaccggcccctccggctactgcgactcctccggctgctactggttcgacccc

SEQ ID NO: 21619 - RNA, 54 nt, synthetic construct
  misc_feature 1..54: note = derived and/or modified sequence opt2 from anti-HIV_CDR
  source 1..54: mol_type = other RNA
ggcggctccatgatccgcggcgtcccctcccccttctactacggcatggacgtc

SEQ ID NO: 21620 - RNA, 54 nt, synthetic construct
  misc_feature 1..54: note = derived and/or modified sequence opt2 from anti-HIV_CDR
  source 1..54: mol_type = other RNA
ctcttcggcgccaagcgcctcggcgtcgccccctccggctactacatggacgtc

SEQ ID NO: 21621 - RNA, 54 nt, synthetic construct
  misc_feature 1..54: note = derived and/or modified sequence opt2 from anti-HIV_CDR
  source 1..54: mol_type = other RNA
gaccgctacgaggccgcctggttcggcgccgacaaggtctacggcatggacgtc

SEQ ID NO: 21622 - RNA, 54 nt, synthetic construct
  misc_feature 1..54: note = derived and/or modified sequence opt2 from anti-HIV_CDR
  source 1..54: mol_type = other RNA
gagcaccgcctccccccccccaccggccgccgcacccgcaactggttcgacccc

SEQ ID NO: 21623 - RNA, 54 nt, synthetic construct
  misc_feature 1..54: note = derived and/or modified sequence opt2 from anti-HIV_CDR
  source 1..54: mol_type = other RNA
ggccgcggctccttccagggcttccagcagtacgagtactacggcatggacgtc

SEQ ID NO: 21624 - RNA, 54 nt, synthetic construct
  misc_feature 1..54: note = derived and/or modified sequence opt2 from anti-HIV_CDR
  source 1..54: mol_type = other RNA
ggccgcggctactcccacggcttccagcagtacaactactacggcatggacgtc

SEQ ID NO: 21625 - RNA, 54 nt, synthetic construct
  misc_feature 1..54: note = derived and/or modified sequence opt2 from anti-HIV_CDR
  source 1..54: mol_type = other RNA
ggccgcggctccttcaccggcttcgaccagtaccactactacggcatggacgtc

SEQ ID NO: 21626 - RNA, 54 nt, synthetic construct
  misc_feature 1..54: note = derived and/or modified sequence opt2 from anti-HIV_CDR
  source 1..54: mol_type = other RNA
ggccgcggctccaccttcccctccgcccagttctcctacttcggcctcgacgtc

SEQ ID NO: 21627 - RNA, 54 nt, synthetic construct
  misc_feature 1..54: note = derived and/or modified sequence opt2 from anti-HIV_CDR
  source 1..54: mol_type = other RNA
gacctcgcccgctacggcgtcacctccatcgtccccgagttcggcttcgacttc

SEQ ID NO: 21628 - RNA, 54 nt, synthetic construct
  misc_feature 1..54: note = derived and/or modified sequence opt2 from anti-HIV_CDR
  source 1..54: mol_type = other RNA
cgcggccgcctcaacatcccctccccctccgccatcctcaccgccttcgacgtc

SEQ ID NO: 21629 - RNA, 54 nt, synthetic construct
  misc_feature 1..54: note = derived and/or modified sequence opt2 from anti-HIV_CDR
  source 1..54: mol_type = other RNA
ggccccggctccatggtccgcggcctcatcgtcacctcctacggcatggacgtc

SEQ ID NO: 21630 - RNA, 54 nt, synthetic construct
  misc_feature 1..54: note = derived and/or modified sequence opt2 from anti-HIV_CDR
  source 1..54: mol_type = other RNA
aagcgcgtcaccatcttcggcgtcgtcgacaccccccgcggctacttcgactac

SEQ ID NO: 21631 - RNA, 54 nt, synthetic construct
  misc_feature 1..54: note = derived and/or modified sequence opt2 from anti-HIV_CDR
  source 1..54: mol_type = other RNA
ggccagcgcaacgtcctccacttcctcgagcgcaagaacgacgccttcgacatc

SEQ ID NO: 21632 - RNA, 54 nt, synthetic construct
  misc_feature 1..54: note = derived and/or modified sequence opt2 from anti-HIV_CDR
  source 1..54: mol_type = other RNA
gagcagaaggactacgacttctggaacggcctctacaagtacggcatggacgtc

SEQ ID NO: 21633 - RNA, 57 nt, synthetic construct
  misc_feature 1..57: note = derived and/or modified sequence opt2 from anti-HIV_CDR
  source 1..57: mol_type = other RNA
gacaccaccaccttcaccaccttcggcggcggccccaacatgggcggcttcgacccc

SEQ ID NO: 21634 - RNA, 57 nt, synthetic construct
  misc_feature 1..57: note = derived and/or modified sequence opt2 from anti-HIV_CDR
  source 1..57: mol_type = other RNA
gccggcctcgactacaacttctggaacggcaagggccgcaagggcgccttcgacgtc

SEQ ID NO: 21635 - RNA, 57 nt, synthetic construct
  misc_feature 1..57: note = derived and/or modified sequence opt2 from anti-HIV_CDR
  source 1..57: mol_type = other RNA
aacgaggccgactaccacgacggcaacggccactccctccgcggcatgttcgactac

SEQ ID NO: 21636 - RNA, 57 nt, synthetic construct
  misc_feature 1..57: note = derived and/or modified sequence opt2 from anti-HIV_CDR
  source 1..57: mol_type = other RNA
aacgagccccagtaccacgacggcaacggccactccctccccggcatgttcgactcc

SEQ ID NO: 21637 - RNA, 57 nt, synthetic construct
  misc_feature 1..57: note = derived and/or modified sequence opt2 from anti-HIV_CDR
  source 1..57: mol_type = other RNA
aacgagccccagtaccacgacgacaacggccactccctccccggcatgatcgactac

SEQ ID NO: 21638 - RNA, 57 nt, synthetic construct
  misc_feature 1..57: note = derived and/or modified sequence opt2 from anti-HIV_CDR
  source 1..57: mol_type = other RNA
aacgagccccagtaccacgacggcaacggccactccctccccggcatgttcgacttc

SEQ ID NO: 21639 - RNA, 57 nt, synthetic construct
  misc_feature 1..57: note = derived and/or modified sequence opt2 from anti-HIV_CDR
  source 1..57: mol_type = other RNA
aacgagccccagtacttcgacggctccggccactccctccccggcatgttcgactac

SEQ ID NO: 21640 - RNA, 57 nt, synthetic construct
  misc_feature 1..57: note = derived and/or modified sequence opt2 from anti-HIV_CDR
  source 1..57: mol_type = other RNA
cgcgaggccgactaccacgacggcaacggccacaccctccccggcatgttcgacttc

SEQ ID NO: 21641 - RNA, 57 nt, synthetic construct
  misc_feature 1..57: note = derived and/or modified sequence opt2 from anti-HIV_CDR
  source 1..57: mol_type = other RNA
aacgagccccagtactacgacggctccggccactccctccccggcatgttcgactac

SEQ ID NO: 21642 - RNA, 57 nt, synthetic construct
  misc_feature 1..57: note = derived and/or modified sequence opt2 from anti-HIV_CDR
  source 1..57: mol_type = other RNA
aacgagccccagtaccacgacggcaacggccactccctccccggcatgttcgactac

SEQ ID NO: 21643 - RNA, 57 nt, synthetic construct
  misc_feature 1..57: note = derived and/or modified sequence opt2 from anti-HIV_CDR
  source 1..57: mol_type = other RNA
caggactccgacttccacgacggccacggccacaccctccgcggcatgttcgactcc

SEQ ID NO: 21644 - RNA, 57 nt, synthetic construct
  misc_feature 1..57: note = derived and/or modified sequence opt2 from anti-HIV_CDR
  source 1..57: mol_type = other RNA
ctcgactgggtccgcggcgtcatgaacctcgtcgagaaccactacgccatggacgtc

SEQ ID NO: 21645 - RNA, 57 nt, synthetic construct
  misc_feature 1..57: note = derived and/or modified sequence opt2 from anti-HIV_CDR
  source 1..57: mol_type = other RNA
accaacggcaccgagatcttccgccccggcggcggcgacatgcgcgacaactggcgc

SEQ ID NO: 21646 - RNA, 57 nt, synthetic construct
  misc_feature 1..57: note = derived and/or modified sequence opt2 from anti-HIV_CDR
  source 1..57: mol_type = other RNA
gacggccgctactccggcgacgaccagtactactaccactactactacatggacgtc

SEQ ID NO: 21647 - RNA, 57 nt, synthetic construct
  misc_feature 1..57: note = derived and/or modified sequence opt2 from anti-HIV_CDR
  source 1..57: mol_type = other RNA
ctcaccaagaacccctcccaggacttctggggctcctacctctactacttcgaggac

SEQ ID NO: 21648 - RNA, 57 nt, synthetic construct
  misc_feature 1..57: note = derived and/or modified sequence opt2 from anti-HIV_CDR
  source 1..57: mol_type = other RNA
ggcgccacctactactacgactcctccggccaccagtcccgccgcgccttcgacatc

SEQ ID NO: 21649 - RNA, 57 nt, synthetic construct
  misc_feature 1..57: note = derived and/or modified sequence opt2 from anti-HIV_CDR
  source 1..57: mol_type = other RNA
gccttccaggcctccatggtccgcggcgtcatcgtcgacccctacggcatggacgtc

SEQ ID NO: 21650 - RNA, 57 nt, synthetic construct
  misc_feature 1..57: note = derived and/or modified sequence opt2 from anti-HIV_CDR
  source 1..57: mol_type = other RNA
caccgcgccgactacgacttctggaacggctccaacctccgcggctacttcgacccc

SEQ ID NO: 21651 - RNA, 57 nt, synthetic construct
  misc_feature 1..57: note = derived and/or modified sequence opt2 from anti-HIV_CDR
  source 1..57: mol_type = other RNA
caccgcgccaactacgacttctggggcggctccaacctccgcggctacttcgacccc

SEQ ID NO: 21652 - RNA, 57 nt, synthetic construct
  misc_feature 1..57: note = derived and/or modified sequence opt2 from anti-HIV_CDR
  source 1..57: mol_type = other RNA
ggcttccacttctggtccggcaccggcacccgcccccgcaactggtacttcgacctc

SEQ ID NO: 21653 - RNA, 57 nt, synthetic construct
  misc_feature 1..57: note = derived and/or modified sequence opt2 from anti-HIV_CDR
  source 1..57: mol_type = other RNA
aactacctcatcgagtcccgctacgacgagaaggactactactacgccatggacgtc

SEQ ID NO: 21654 - RNA, 57 nt, synthetic construct
  misc_feature 1..57: note = derived and/or modified sequence opt2 from anti-HIV_CDR
  source 1..57: mol_type = other RNA
tcccgcggctacgcctacgactccggcggccactacttccccacctggttcgacccc

SEQ ID NO: 21655 - RNA, 57 nt, synthetic construct
  misc_feature 1..57: note = derived and/or modified sequence opt2 from anti-HIV_CDR
  source 1..57: mol_type = other RNA
gacaccaccaccttcggcgccttcggcggctcccccaacatgggcggcctcgacccc

SEQ ID NO: 21656 - RNA, 57 nt, synthetic construct
  misc_feature 1..57: note = derived and/or modified sequence opt2 from anti-HIV_CDR
  source 1..57: mol_type = other RNA
cacctcgtcgtcgccgtcgccgccggccccgactacttctcctacggcatggacgtc

SEQ ID NO: 21657 - RNA, 57 nt, synthetic construct
  misc_feature 1..57: note = derived and/or modified sequence opt2 from anti-HIV_CDR
  source 1..57: mol_type = other RNA
gacaccaccaccttctcctccttcggctccccccccaacatgggcggcctcgacccc

SEQ ID NO: 21658 - RNA, 57 nt, synthetic construct
  misc_feature 1..57: note = derived and/or modified sequence opt2 from anti-HIV_CDR
  source 1..57: mol_type = other RNA
gacaccaccaccttcggcgccttcggcggcggcgccaacatgggcggcctcgacccc

SEQ ID NO: 21659 - RNA, 57 nt, synthetic construct
  misc_feature 1..57: note = derived and/or modified sequence opt2 from anti-HIV_CDR
  source 1..57: mol_type = other RNA
gacaccaccaccttcacctccttcggctcccccccccgcatgggcggcctcgacccc

SEQ ID NO: 21660 - RNA, 57 nt, synthetic construct
  misc_feature 1..57: note = derived and/or modified sequence opt2 from anti-HIV_CDR
  source 1..57: mol_type = other RNA
gacaccaccaccttctcctccttcggctcccccccccacatgggcggcctcgacccc

SEQ ID NO: 21661 - RNA, 57 nt, synthetic construct
  misc_feature 1..57: note = derived and/or modified sequence opt2 from anti-HIV_CDR
  source 1..57: mol_type = other RNA
gaccgcgtctccgactacgacttctggtccggcaagcgcggctacggcatggacgtc

SEQ ID NO: 21662 - RNA, 57 nt, synthetic construct
  misc_feature 1..57: note = derived and/or modified sequence opt2 from anti-HIV_CDR
  source 1..57: mol_type = other RNA
gagctctccggcgagtaccacttctggtccggcacctaccgctacggcgtcgacgtc

SEQ ID NO: 21663 - RNA, 57 nt, synthetic construct
  misc_feature 1..57: note = derived and/or modified sequence opt2 from anti-HIV_CDR
  source 1..57: mol_type = other RNA
cacggcgcctccgagaactacggccccggctcctactccgccgagcacttccagcac

SEQ ID NO: 21664 - RNA, 57 nt, synthetic construct
  misc_feature 1..57: note = derived and/or modified sequence opt2 from anti-HIV_CDR
  source 1..57: mol_type = other RNA
cacggcgcctccgccaactacggccccggctcctactccgccgagcacttccagcac

SEQ ID NO: 21665 - RNA, 60 nt, synthetic construct
  misc_feature 1..60: note = derived and/or modified sequence opt2 from anti-HIV_CDR
  source 1..60: mol_type = other RNA
cacgaggccccccgctactcctacgccttccgccgctactaccactacggcctcgacgtc

SEQ ID NO: 21666 - RNA, 60 nt, synthetic construct
  misc_feature 1..60: note = derived and/or modified sequence opt2 from anti-HIV_CDR
  source 1..60: mol_type = other RNA
acctccacctacgaccagtggtccggcctccaccacgacggcgtcatggccttctcctcc

SEQ ID NO: 21667 - RNA, 60 nt, synthetic construct
  misc_feature 1..60: note = derived and/or modified sequence opt2 from anti-HIV_CDR
  source 1..60: mol_type = other RNA
ggcgagttcgactcctccggcttcgactacgagtcctggtacccctactacatggacgtc

SEQ ID NO: 21668 - RNA, 60 nt, synthetic construct
  misc_feature 1..60: note = derived and/or modified sequence opt2 from anti-HIV_CDR
  source 1..60: mol_type = other RNA
ggccagaccgacctcaacgacgacttctggtccgagtactccacccccggcttcgactac

SEQ ID NO: 21669 - RNA, 60 nt, synthetic construct
  misc_feature 1..60: note = derived and/or modified sequence opt2 from anti-HIV_CDR
  source 1..60: mol_type = other RNA
ggccagaccgacctcaacgacgacctctggtccgactactccacccccggcttcgactac

SEQ ID NO: 21670 - RNA, 60 nt, synthetic construct
  misc_feature 1..60: note = derived and/or modified sequence opt2 from anti-HIV_CDR
  source 1..60: mol_type = other RNA
aacctcatcgaggagtcccagacccagcaggagatcaacgagcgcgacctcctcgccctc

SEQ ID NO: 21671 - RNA, 60 nt, synthetic construct
  misc_feature 1..60: note = derived and/or modified sequence opt2 from anti-HIV_CDR
  source 1..60: mol_type = other RNA
aacctcatcgaggagtcccagatccagcaggagaagaacgagaaggagctcctcgagctc

SEQ ID NO: 21672 - RNA, 60 nt, synthetic construct
  misc_feature 1..60: note = derived and/or modified sequence opt2 from anti-HIV_CDR
  source 1..60: mol_type = other RNA
tccctcatcgagaactcccagatccagcaggagaagaacgagcaggacctcctccagctc

SEQ ID NO: 21673 - RNA, 60 nt, synthetic construct
  misc_feature 1..60: note = derived and/or modified sequence opt2 from anti-HIV_CDR
  source 1..60: mol_type = other RNA
tccctcatcgaggagtcccagatccagcaggagaagaacgagaaggagctcctcgagctc

SEQ ID NO: 21674 - RNA, 60 nt, synthetic construct
  misc_feature 1..60: note = derived and/or modified sequence opt2 from anti-HIV_CDR
  source 1..60: mol_type = other RNA
cgcctcatcgaggagtcccagacccagcaggagaagaacgagcaggagctcctcgagctc

SEQ ID NO: 21675 - RNA, 60 nt, synthetic construct
  misc_feature 1..60: note = derived and/or modified sequence opt2 from anti-HIV_CDR
  source 1..60: mol_type = other RNA
tccctcatcgaggagtcccagacccagcaggagaagaacgagaaggagctcctcgagctc

SEQ ID NO: 21676 - RNA, 60 nt, synthetic construct
  misc_feature 1..60: note = derived and/or modified sequence opt2 from anti-HIV_CDR
  source 1..60: mol_type = other RNA
aacctcctcgaggagtcccagaaccagcaggagaagaacgagcaggagctcctcgagctc

SEQ ID NO: 21677 - RNA, 60 nt, synthetic construct
  misc_feature 1..60: note = derived and/or modified sequence opt2 from anti-HIV_CDR
  source 1..60: mol_type = other RNA
accctcatcgaggagtcccagaaccagcaggagaagaacgagctcgagctcctcgagctc

SEQ ID NO: 21678 - RNA, 60 nt, synthetic construct
  misc_feature 1..60: note = derived and/or modified sequence opt2 from anti-HIV_CDR
  source 1..60: mol_type = other RNA
accctccaggaggagtcccagaaccagcaggagaagaacgagcaggagctcctcgagctc

SEQ ID NO: 21679 - RNA, 60 nt, synthetic construct
  misc_feature 1..60: note = derived and/or modified sequence opt2 from anti-HIV_CDR
  source 1..60: mol_type = other RNA
tccctcctcgaggagtcccagaaccagcaggagaagaacgagcaggagctcctcgagctc

SEQ ID NO: 21680 - RNA, 60 nt, synthetic construct
  misc_feature 1..60: note = derived and/or modified sequence opt2 from anti-HIV_CDR
  source 1..60: mol_type = other RNA
accctcatcgaggagtcccagaaccagcaggagaagaaccagcaggagctcctccagctc

SEQ ID NO: 21681 - RNA, 60 nt, synthetic construct
  misc_feature 1..60: note = derived and/or modified sequence opt2 from anti-HIV_CDR
  source 1..60: mol_type = other RNA
accctcatcgaggagtcccagaaccagcaggagaagaacgagcaggagctcctcggcctc

SEQ ID NO: 21682 - RNA, 60 nt, synthetic construct
  misc_feature 1..60: note = derived and/or modified sequence opt2 from anti-HIV_CDR
  source 1..60: mol_type = other RNA
accctcatcgaggagtcccagaaccagcaggagaagaacgagcaggagctcctcgagctc

SEQ ID NO: 21683 - RNA, 60 nt, synthetic construct
  misc_feature 1..60: note = derived and/or modified sequence opt2 from anti-HIV_CDR
  source 1..60: mol_type = other RNA
tccctcatcgaggactcccagatccagcaggagaagaacgagaaggagctcctcgagctc

SEQ ID NO: 21684 - RNA, 60 nt, synthetic construct
  misc_feature 1..60: note = derived and/or modified sequence opt2 from anti-HIV_CDR
  source 1..60: mol_type = other RNA
tccctcctcgagaagtcccagacccagcaggagaagaacgagcaggagctcctcgagctc

SEQ ID NO: 21685 - RNA, 60 nt, synthetic construct
  misc_feature 1..60: note = derived and/or modified sequence opt2 from anti-HIV_CDR
  source 1..60: mol_type = other RNA
tccctcatcgaggagtcccagaaccagcaggagaagaacgagcaggagctcctcgagctc

SEQ ID NO: 21686 - RNA, 60 nt, synthetic construct
  misc_feature 1..60: note = derived and/or modified sequence opt2 from anti-HIV_CDR
  source 1..60: mol_type = other RNA
ggcgacctcctcggctacaccgactcctggtacgagttcgactactactacatggacgtc

SEQ ID NO: 21687 - RNA, 60 nt, synthetic construct
  misc_feature 1..60: note = derived and/or modified sequence opt2 from anti-HIV_CDR
  source 1..60: mol_type = other RNA
gacaccaacggcaccgagatcttccgccccggcggcggcgacatgcgcgacaactggcgc

SEQ ID NO: 21688 - RNA, 60 nt, synthetic construct
  misc_feature 1..60: note = derived and/or modified sequence opt2 from anti-HIV_CDR
  source 1..60: mol_type = other RNA
gacgtcgtcgagcgccccggcttcggcgacttccgctacgactactacggcatggacgtc

SEQ ID NO: 21689 - RNA, 60 nt, synthetic construct
  misc_feature 1..60: note = derived and/or modified sequence opt2 from anti-HIV_CDR
  source 1..60: mol_type = other RNA
gaccagcgcgactgctccaccaaccgctgcttcggcgtcttcggctactacatggacgtc

SEQ ID NO: 21690 - RNA, 60 nt, synthetic construct
  misc_feature 1..60: note = derived and/or modified sequence opt2 from anti-HIV_CDR
  source 1..60: mol_type = other RNA
gaccgctgggtccgcccccagttcccctccatggacttccagtacaacggcctcgacgtc

SEQ ID NO: 21691 - RNA, 60 nt, synthetic construct
  misc_feature 1..60: note = derived and/or modified sequence opt2 from anti-HIV_CDR
  source 1..60: mol_type = other RNA
gactccggcttcgacctcgactactacgacaccaacgagctctacttcggcttcgactac

SEQ ID NO: 21692 - RNA, 60 nt, synthetic construct
  misc_feature 1..60: note = derived and/or modified sequence opt2 from anti-HIV_CDR
  source 1..60: mol_type = other RNA
aagtaccccgcctactacgacatcctcaccgccaactaccgctcctactacttcgactac

SEQ ID NO: 21693 - RNA, 60 nt, synthetic construct
  misc_feature 1..60: note = derived and/or modified sequence opt2 from anti-HIV_CDR
  source 1..60: mol_type = other RNA
aagtaccccgcctactacgacatcctcaccggctactaccgcaactactacttcgactac

SEQ ID NO: 21694 - RNA, 60 nt, synthetic construct
  misc_feature 1..60: note = derived and/or modified sequence opt2 from anti-HIV_CDR
  source 1..60: mol_type = other RNA
cgcgtcaagttccccctctggttcggcgagaccacctactactactacggcatggacgtc

SEQ ID NO: 21695 - RNA, 60 nt, synthetic construct
  misc_feature 1..60: note = derived and/or modified sequence opt2 from anti-HIV_CDR
  source 1..60: mol_type = other RNA
gagcgctccaccaagtactccttctggtccgccgtcatgcgccccgacgccttcgacctc

SEQ ID NO: 21696 - RNA, 60 nt, synthetic construct
  misc_feature 1..60: note = derived and/or modified sequence opt2 from anti-HIV_CDR
  source 1..60: mol_type = other RNA
cacgaggccccccgctactcctacgccttccgcaactactaccactacggcctcgacgtc

SEQ ID NO: 21697 - RNA, 60 nt, synthetic construct
  misc_feature 1..60: note = derived and/or modified sequence opt2 from anti-HIV_CDR
  source 1..60: mol_type = other RNA
gagaacgtcctcatggagtccgacgactacaacgactactactactactacatggacgtc

SEQ ID NO: 21698 - RNA, 60 nt, synthetic construct
  misc_feature 1..60: note = derived and/or modified sequence opt2 from anti-HIV_CDR
  source 1..60: mol_type = other RNA
gagcgcgtcctcgtcttccccgaccaggacgccgactactactactacttcttcgacgtc

SEQ ID NO: 21699 - RNA, 60 nt, synthetic construct
  misc_feature 1..60: note = derived and/or modified sequence opt2 from anti-HIV_CDR
  source 1..60: mol_type = other RNA
gagcgcgtcctcgtcgtccccgaccaggacgccgactactactactacttcttcgacgtc

SEQ ID NO: 21700 - RNA, 63 nt, synthetic construct
  misc_feature 1..63: note = derived and/or modified sequence opt2 from anti-HIV_CDR
  source 1..63: mol_type = other RNA
gaccgctcctccgccatcggctactgctcctccatctcctgctacaagggctccttcgacatc

SEQ ID NO: 21701 - RNA, 63 nt, synthetic construct
  misc_feature 1..63: note = derived and/or modified sequence opt2 from anti-HIV_CDR
  source 1..63: mol_type = other RNA
gtcgtcaagatcgagcccctcggcgtcgcccccaccaaggccaagcgcgtcgcccgcgagaag

SEQ ID NO: 21702 - RNA, 63 nt, synthetic construct
  misc_feature 1..63: note = derived and/or modified sequence opt2 from anti-HIV_CDR
  source 1..63: mol_type = other RNA
gtcgtccgcatcgagcccctcggcgtcgcccccaccaaggccaagcgcgtcgagcgcgagaag

SEQ ID NO: 21703 - RNA, 63 nt, synthetic construct
  misc_feature 1..63: note = derived and/or modified sequence opt2 from anti-HIV_CDR
  source 1..63: mol_type = other RNA
gtcgtccgcatcgagcccctcggcatcgcccccacccgcgccaagcgcgtcgagcgcgagaag

SEQ ID NO: 21704 - RNA, 63 nt, synthetic construct
  misc_feature 1..63: note = derived and/or modified sequence opt2 from anti-HIV_CDR
  source 1..63: mol_type = other RNA
gtcgtcaagatcgagcccatcggcgtcgcccccaccaaggcccgccgcgtcgagcgcgagaag

SEQ ID NO: 21705 - RNA, 63 nt, synthetic construct
  misc_feature 1..63: note = derived and/or modified sequence opt2 from anti-HIV_CDR
  source 1..63: mol_type = other RNA
gtcgtcaagatcgagcccctcggcgtcgcccccacccgcgccaagcgcgtcgagcgcgagaag

SEQ ID NO: 21706 - RNA, 63 nt, synthetic construct
  misc_feature 1..63: note = derived and/or modified sequence opt2 from anti-HIV_CDR
  source 1..63: mol_type = other RNA
gtcgtccagatcgagcccctcggcgtcgcccccacccgcgccaagcgcgtcgagcgcgagaag

SEQ ID NO: 21707 - RNA, 63 nt, synthetic construct
  misc_feature 1..63: note = derived and/or modified sequence opt2 from anti-HIV_CDR
  source 1..63: mol_type = other RNA
gtcgtccgcatcgagcccctcggcgtcgcccccaccaaggccaagcgcgtccagcgcgagaag

SEQ ID NO: 21708 - RNA, 63 nt, synthetic construct
  misc_feature 1..63: note = derived and/or modified sequence opt2 from anti-HIV_CDR
  source 1..63: mol_type = other RNA
gtcgtcaagatcgagcccctcggcgtcgcccccaccaaggccaagcgcgtccagcgcaagaag

SEQ ID NO: 21709 - RNA, 63 nt, synthetic construct
  misc_feature 1..63: note = derived and/or modified sequence opt2 from anti-HIV_CDR
  source 1..63: mol_type = other RNA
gtcatcaagatcgagcccctcatcgtcgcccccaccaaggccaagcgcgtccagcgcgagaag

SEQ ID NO: 21710 - RNA, 63 nt, synthetic construct
  misc_feature 1..63: note = derived and/or modified sequence opt2 from anti-HIV_CDR
  source 1..63: mol_type = other RNA
gtcgtcaagatcgagcccctcggcgtcgcccccaccaaggcccgccgcgtccagcgcgagaag

SEQ ID NO: 21711 - RNA, 63 nt, synthetic construct
  misc_feature 1..63: note = derived and/or modified sequence opt2 from anti-HIV_CDR
  source 1..63: mol_type = other RNA
gtcgtcaagatcgagctcctcggcgtcgcccccaccaaggccaagcgcgtccagcgcgagaag

SEQ ID NO: 21712 - RNA, 63 nt, synthetic construct
  misc_feature 1..63: note = derived and/or modified sequence opt2 from anti-HIV_CDR
  source 1..63: mol_type = other RNA
gtcgtcaccatcgagcccctcggcgtcgcccccaccaaggccaagcgcgtccagcgcgagaag

SEQ ID NO: 21713 - RNA, 63 nt, synthetic construct
  misc_feature 1..63: note = derived and/or modified sequence opt2 from anti-HIV_CDR
  source 1..63: mol_type = other RNA
gtcgtcaagatcgagcccctcggcgtcgcccccaccaaggccaagcgcgtccagcgcgagaag

SEQ ID NO: 21714 - RNA, 63 nt, synthetic construct
  misc_feature 1..63: note = derived and/or modified sequence opt2 from anti-HIV_CDR
  source 1..63: mol_type = other RNA
gacctcgtctccgtctcccccccctacggcaactacggccccgacaacaactggttcgacttc

SEQ ID NO: 21715 - RNA, 63 nt, synthetic construct
  misc_feature 1..63: note = derived and/or modified sequence opt2 from anti-HIV_CDR
  source 1..63: mol_type = other RNA
atgaaccccccctggttccgcggcggctccaacaacccctactcctactactacatggacgtc

SEQ ID NO: 21716 - RNA, 63 nt, synthetic construct
  misc_feature 1..63: note = derived and/or modified sequence opt2 from anti-HIV_CDR
  source 1..63: mol_type = other RNA
gactggatcggctacgactacgacggctccggctcccacctccgcgacgagtccttcgacatc

SEQ ID NO: 21717 - RNA, 63 nt, synthetic construct
  misc_feature 1..63: note = derived and/or modified sequence opt2 from anti-HIV_CDR
  source 1..63: mol_type = other RNA
tgctccatcgtcggcaacggcgacttcctcgaggaggactcccactaccccgccatggacgtc

SEQ ID NO: 21718 - RNA, 63 nt, synthetic construct
  misc_feature 1..63: note = derived and/or modified sequence opt2 from anti-HIV_CDR
  source 1..63: mol_type = other RNA
gacttcgtctccatctacggcgtcgcctacttcaccggcggcggcccctcctcccccgacatc

SEQ ID NO: 21719 - RNA, 66 nt, synthetic construct
  misc_feature 1..66: note = derived and/or modified sequence opt2 from anti-HIV_CDR
  source 1..66: mol_type = other RNA
aaggccaaggactactactacgagtcctccgactactccccctactactactactacatggacgtc

SEQ ID NO: 21720 - RNA, 66 nt, synthetic construct
  misc_feature 1..66: note = derived and/or modified sequence opt2 from anti-HIV_CDR
  source 1..66: mol_type = other RNA
gaccacggcatcaagcccgacaactactacgacatctccggctacaacctcgactacttcgactac

SEQ ID NO: 21721 - RNA, 66 nt, synthetic construct
  misc_feature 1..66: note = derived and/or modified sequence opt2 from anti-HIV_CDR
  source 1..66: mol_type = other RNA
ggctccctctacgactaccgcgacaacgccgacctcaagccctcctactactacgccatggacgtc

SEQ ID NO: 21722 - RNA, 66 nt, synthetic construct
  misc_feature 1..66: note = derived and/or modified sequence opt2 from anti-HIV_CDR
  source 1..66: mol_type = other RNA
gacgaggcctcctgggtcgaggccgccgacgagtgggacgagcacctcttccgcgagatggccgtc

SEQ ID NO: 21723 - RNA, 66 nt, synthetic construct
  misc_feature 1..66: note = derived and/or modified sequence opt2 from anti-HIV_CDR
  source 1..66: mol_type = other RNA
gacgaggtctcctgggtcgaggccgccgacgagtgggacgagcacctcttccgcgagatggccgtc

SEQ ID NO: 21724 - RNA, 66 nt, synthetic construct
  misc_feature 1..66: note = derived and/or modified sequence opt2 from anti-HIV_CDR
  source 1..66: mol_type = other RNA
gacgagggctcctgggtcgaggccgccgacgagtgggacgagcacctcttccgcgagatggccgtc

SEQ ID NO: 21725 - RNA, 66 nt, synthetic construct
  misc_feature 1..66: note = derived and/or modified sequence opt2 from anti-HIV_CDR
  source 1..66: mol_type = other RNA
gaccagcgcggccgctactccttcggcttcgtcaccggccagaccaaggtctccgccatctccgac

SEQ ID NO: 21726 - RNA, 66 nt, synthetic construct
  misc_feature 1..66: note = derived and/or modified sequence opt2 from anti-HIV_CDR
  source 1..66: mol_type = other RNA
gaccagctcggccgctactccttcggcttcgtcaccggccagaacaaggtctccgccatctccgac

SEQ ID NO: 21727 - RNA, 66 nt, synthetic construct
  misc_feature 1..66: note = derived and/or modified sequence opt2 from anti-HIV_CDR
  source 1..66: mol_type = other RNA
gaccaggtcggccgctactccttcggcttcgccaccggccagcagcgcgtctccgccatctccgac

SEQ ID NO: 21728 - RNA, 69 nt, synthetic construct
  misc_feature 1..69: note = derived and/or modified sequence opt2 from anti-HIV_CDR
  source 1..69: mol_type = other RNA
gtcgtcaagatcgagcccctcggcgtcgcccccaccaaggccaagcgccgcgtcgtccagcgcgagaag

SEQ ID NO: 21729 - RNA, 69 nt, synthetic construct
  misc_feature 1..69: note = derived and/or modified sequence opt2 from anti-HIV_CDR
  source 1..69: mol_type = other RNA
cgcatctcctcctcctcctggtacatggtcgacaactcccacaccctccacttctactacatggacgtc

SEQ ID NO: 21730 - RNA, 69 nt, synthetic construct
  misc_feature 1..69: note = derived and/or modified sequence opt2 from anti-HIV_CDR
  source 1..69: mol_type = other RNA
gacaagcccgcctacgacgagtacgccgaggagaccatcgccccccacaactaccacgccatggacctc

SEQ ID NO: 21731 - RNA, 69 nt, synthetic construct
  misc_feature 1..69: note = derived and/or modified sequence opt2 from anti-HIV_CDR
  source 1..69: mol_type = other RNA
cagaacatcgccgcccgcgccgccgagaagctctacgagaacgactactacttctacggcatggacgtc

SEQ ID NO: 21732 - RNA, 69 nt, synthetic construct
  misc_feature 1..69: note = derived and/or modified sequence opt2 from anti-HIV_CDR
  source 1..69: mol_type = other RNA
cagaacatcgccgcccgcaccgccgagcgcctctacgagaacgactactacttctacggcatggacgtc

SEQ ID NO: 21733 - RNA, 72 nt, synthetic construct
  misc_feature 1..72: note = derived and/or modified sequence opt2 from anti-HIV_CDR
  source 1..72: mol_type = other RNA
gcccagcagggcaagcgcatctacggcatcgtctccttcggcgagttcttctactactactacatggacgcc

SEQ ID NO: 21734 - RNA, 72 nt, synthetic construct
  misc_feature 1..72: note = derived and/or modified sequence opt2 from anti-HIV_CDR
  source 1..72: mol_type = other RNA
acccagcagggcaagcgcatctacggcgtcgtctccttcggcgagttcttccactactactacatggacgcc

SEQ ID NO: 21735 - RNA, 72 nt, synthetic construct
  misc_feature 1..72: note = derived and/or modified sequence opt2 from anti-HIV_CDR
  source 1..72: mol_type = other RNA
gcccgccgcggccagcgcatctacggcgtcgtctccttcggcgagttcttctactactactccatggacgtc

SEQ ID NO: 21736 - RNA, 72 nt, synthetic construct
  misc_feature 1..72: note = derived and/or modified sequence opt2 from anti-HIV_CDR
  source 1..72: mol_type = other RNA
accctccacggccgccgcatctacggcatcgtcgccttcaacgagtggttcacctacttctacatggacgtc

SEQ ID NO: 21737 - RNA, 72 nt, synthetic construct
  misc_feature 1..72: note = derived and/or modified sequence opt2 from anti-HIV_CDR
  source 1..72: mol_type = other RNA
accaagcacggccgccgcatctacggcatcgtcgccttcaacgagtggttcacctacttctacatggacgtc

SEQ ID NO: 21738 - RNA, 72 nt, synthetic construct
  misc_feature 1..72: note = derived and/or modified sequence opt2 from anti-HIV_CDR
  source 1..72: mol_type = other RNA
gcccgccacggccagcgcatctacggcgtcgtctccttcggcgagttcttcacctactactccatggacgtc

SEQ ID NO: 21739 - RNA, 72 nt, synthetic construct
  misc_feature 1..72: note = derived and/or modified sequence opt2 from anti-HIV_CDR
  source 1..72: mol_type = other RNA
acccagcagggcaagcgcatctacggcgtcgtctccttcggcgactactactactactactacatggacgtc

SEQ ID NO: 21740 - RNA, 72 nt, synthetic construct
  misc_feature 1..72: note = derived and/or modified sequence opt2 from anti-HIV_CDR
  source 1..72: mol_type = other RNA
accaagcacggccgccgcatctacggcgtcgtcgccttcggcgagtggttcacctacttctacatggacgtc

SEQ ID NO: 21741 - RNA, 72 nt, synthetic construct
  misc_feature 1..72: note = derived and/or modified sequence opt2 from anti-HIV_CDR
  source 1..72: mol_type = other RNA
gccgtcatcaccgacctccacaccttcggcgactacgagctcgaggacccctcctactactacatggacgtc

SEQ ID NO: 21742 - RNA, 72 nt, synthetic construct
  misc_feature 1..72: note = derived and/or modified sequence opt2 from anti-HIV_CDR
  source 1..72: mol_type = other RNA
gaccgcggcgacacccgcctcctcgactacggcgactacgaggacgagcgctactactacggcatggacgtc

SEQ ID NO: 21743 - RNA, 72 nt, synthetic construct
  misc_feature 1..72: note = derived and/or modified sequence opt2 from anti-HIV_CDR
  source 1..72: mol_type = other RNA
ggcacccgctacgacttctggtccggcttctccaaccgcgacggccgcgccctcgccggctacttcgactac

SEQ ID NO: 21744 - RNA, 72 nt, synthetic construct
  misc_feature 1..72: note = derived and/or modified sequence opt2 from anti-HIV_CDR
  source 1..72: mol_type = other RNA
gacggcaagggcaaggcctactacgacttctggtccggctaccgcaaccagaagtactacggcctcgacgtc

SEQ ID NO: 21745 - RNA, 72 nt, synthetic construct
  misc_feature 1..72: note = derived and/or modified sequence opt2 from anti-HIV_CDR
  source 1..72: mol_type = other RNA
gccgtcatcaccgacctccacaccttcgccgactacgagctcggcgacccctcctacttctacatggacgtc

SEQ ID NO: 21746 - RNA, 72 nt, synthetic construct
  misc_feature 1..72: note = derived and/or modified sequence opt2 from anti-HIV_CDR
  source 1..72: mol_type = other RNA
tccgtcatcaccgacctccacaccttcggcgactacgagtccggcgacccctcctactactacatggacgtc

SEQ ID NO: 21747 - RNA, 81 nt, synthetic construct
  misc_feature 1..81: note = derived and/or modified sequence opt2 from anti-HIV_CDR
  source 1..81: mol_type = other RNA
gacttcccccgcttccaccgcctcgtcggcaactacgacttctggcgcggcaccctcgaccgcttctcctacatggacctc

SEQ ID NO: 21748 - RNA, 105 nt, synthetic construct
  misc_feature 1..105: note = derived and/or modified sequence opt2 from anti-HIV_CDR
  source 1..105: mol_type = other RNA
cgcatcctcgccgtcgagcgctacctcaaggaccagcagctcctcggcatctggggctgctccggcaagatcatctgccccaccatggtcccctggaactcctcc

SEQ ID NO: 21749 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctccaggaccagcgcctcctcggcatgtggggctgctccggcaagcacatctgcaccaccttcgtcccctggaactcctcc

SEQ ID NO: 21750 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagtcctacctcaaggaccagcagctcctcggcatctggggctgctccggcaagcacatctgcaccaccaccgtcccctggaactcctcc

SEQ ID NO: 21751 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctccgcgaccagcagctcctcggcatctggggctgctccggccgccacatctgcaccaccaacgtcccctggaactcctcc

SEQ ID NO: 21752 - RNA, 105 nt, synthetic construct
  misc_feature 1..105: note = derived and/or modified sequence opt2 from anti-HIV_CDR
  source 1..105: mol_type = other RNA
cgcatcctcgccgtcgagcgctacctcaaggaccagcagctcctcggcatctggggctgctccggcaagctcatctgcaccaccaccgtcccctggaactcctcc

SEQ ID NO: 21753 - RNA, 105 nt, synthetic construct
  misc_feature 1..105: note = derived and/or modified sequence opt2 from anti-HIV_CDR
  source 1..105: mol_type = other RNA
cgcatcctcgccgtcgagcgctacctcaaggaccagcagctcctcggcatctggggctgctccggcaagcacatctgcaccaccaacgtcccctggaactcctcc

SEQ ID NO: 21754 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctccgcgaccagcagctcctcggcatctggggctgctccggcaagctcatctgcaccaccaccgtcccctggaacgcctcc

SEQ ID NO: 21755 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctccgcgaccagcagctcctcggcatctggggctgctccggcaagctcatctgcaccaccgccgtcccctggaacgcctcc

SEQ ID NO: 21756 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctcaaggaccagcagctcctcggcatctggggctgctccggcaagctcatctgcaccaccaccgtcccctggaacgcctcc

SEQ ID NO: 21757 - RNA, 105 nt, synthetic construct
  misc_feature 1..105: note = derived and/or modified sequence opt2 from anti-HIV_CDR
  source 1..105: mol_type = other RNA
cgcatcctcgccgtcgagcgctacctcaaggaccagcagctcctcggcttctggggctgctccggcaagctcatctgcaccaccgccgtcccctggaacgcctcc

SEQ ID NO: 21758 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctccgcgaccagcagctcctcggcatctggggctgctccggcaagctcatctgcaccaccaccgtcccctggaacacctcc

SEQ ID NO: 21759 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctcaaggaccagcagctcctcggcatctggggctgctccggcaagctcatctgcaccaccgccgtcccctggaacgcctcc

SEQ ID NO: 21760 - RNA, 105 nt, synthetic construct
  misc_feature 1..105: note = derived and/or modified sequence opt2 from anti-HIV_CDR
  source 1..105: mol_type = other RNA
cgcgtcctcgccgtcgagcgctacctcaaggaccagcagctcctcggcttctggggctgctccggcaagctcatctgcaccaccaccgtcccctggaacgcctcc

SEQ ID NO: 21761 - RNA, 105 nt, synthetic construct
  misc_feature 1..105: note = derived and/or modified sequence opt2 from anti-HIV_CDR
  source 1..105: mol_type = other RNA
cgcatcctcgccgtcgagcgctacctcaaggaccagcagctcctcggcatctggggctgctccggcaagctcatctgcaccaccgccgtcccctggaacgcctcc

SEQ ID NO: 21762-21787 - skipped (26 entries)

SEQ ID NO: 21788 - RNA, 12 nt, synthetic construct
  misc_feature 1..12: note = derived and/or modified sequence opt2 from anti-influenza_CDR
  source 1..12: mol_type = other RNA
gacgtccccgac

SEQ ID NO: 21789 - RNA, 12 nt, synthetic construct
  misc_feature 1..12: note = derived and/or modified sequence opt2 from anti-influenza_CDR
  source 1..12: mol_type = other RNA
cgcctctccggc

SEQ ID NO: 21790 - RNA, 12 nt, synthetic construct
  misc_feature 1..12: note = derived and/or modified sequence opt2 from anti-influenza_CDR
  source 1..12: mol_type = other RNA
ttctgggacctc

SEQ ID NO: 21791 - RNA, 15 nt, synthetic construct
  misc_feature 1..15: note = derived and/or modified sequence opt2 from anti-influenza_CDR
  source 1..15: mol_type = other RNA
accggcctccgcaac

SEQ ID NO: 21792 - RNA, 15 nt, synthetic construct
  misc_feature 1..15: note = derived and/or modified sequence opt2 from anti-influenza_CDR
  source 1..15: mol_type = other RNA
cagcagtcccgcacc

SEQ ID NO: 21793 - RNA, 15 nt, synthetic construct
  misc_feature 1..15: note = derived and/or modified sequence opt2 from anti-influenza_CDR
  source 1..15: mol_type = other RNA
cagctctcccgcacc

SEQ ID NO: 21794 - RNA, 15 nt, synthetic construct
  misc_feature 1..15: note = derived and/or modified sequence opt2 from anti-influenza_CDR
  source 1..15: mol_type = other RNA
tccaactacatcacc

SEQ ID NO: 21795 - RNA, 15 nt, synthetic construct
  misc_feature 1..15: note = derived and/or modified sequence opt2 from anti-influenza_CDR
  source 1..15: mol_type = other RNA
gactactcctggaac

SEQ ID NO: 21796 - RNA, 15 nt, synthetic construct
  misc_feature 1..15: note = derived and/or modified sequence opt2 from anti-influenza_CDR
  source 1..15: mol_type = other RNA
aactacgccttctcc

SEQ ID NO: 21797 - RNA, 15 nt, synthetic construct
  misc_feature 1..15: note = derived and/or modified sequence opt2 from anti-influenza_CDR
  source 1..15: mol_type = other RNA
aagaacgccatctcc

SEQ ID NO: 21798 - RNA, 15 nt, synthetic construct
  misc_feature 1..15: note = derived and/or modified sequence opt2 from anti-influenza_CDR
  source 1..15: mol_type = other RNA
tcccactggatgacc

SEQ ID NO: 21799 - RNA, 15 nt, synthetic construct
  misc_feature 1..15: note = derived and/or modified sequence opt2 from anti-influenza_CDR
  source 1..15: mol_type = other RNA
aactacgacatcaac

SEQ ID NO: 21800 - RNA, 15 nt, synthetic construct
  misc_feature 1..15: note = derived and/or modified sequence opt2 from anti-influenza_CDR
  source 1..15: mol_type = other RNA
gactacggcgtcacc

SEQ ID NO: 21801 - RNA, 15 nt, synthetic construct
  misc_feature 1..15: note = derived and/or modified sequence opt2 from anti-influenza_CDR
  source 1..15: mol_type = other RNA
aactacggcatcaac

SEQ ID NO: 21802 - RNA, 15 nt, synthetic construct
  misc_feature 1..15: note = derived and/or modified sequence opt2 from anti-influenza_CDR
  source 1..15: mol_type = other RNA
ggctacaccatcacc

SEQ ID NO: 21803 - RNA, 15 nt, synthetic construct
  misc_feature 1..15: note = derived and/or modified sequence opt2 from anti-influenza_CDR
  source 1..15: mol_type = other RNA
aactacggcatctcc

SEQ ID NO: 21804 - RNA, 15 nt, synthetic construct
  misc_feature 1..15: note = derived and/or modified sequence opt2 from anti-influenza_CDR
  source 1..15: mol_type = other RNA
gacgactactggacc

SEQ ID NO: 21805 - RNA, 15 nt, synthetic construct
  misc_feature 1..15: note = derived and/or modified sequence opt2 from anti-influenza_CDR
  source 1..15: mol_type = other RNA
acctacgccatgcac

SEQ ID NO: 21806 - RNA, 15 nt, synthetic construct
  misc_feature 1..15: note = derived and/or modified sequence opt2 from anti-influenza_CDR
  source 1..15: mol_type = other RNA
tcctacgccatgcac

SEQ ID NO: 21807 - RNA, 15 nt, synthetic construct
  misc_feature 1..15: note = derived and/or modified sequence opt2 from anti-influenza_CDR
  source 1..15: mol_type = other RNA
tcctactactggaac

SEQ ID NO: 21808 - RNA, 15 nt, synthetic construct
  misc_feature 1..15: note = derived and/or modified sequence opt2 from anti-influenza_CDR
  source 1..15: mol_type = other RNA
acctaccccgtcgcc

SEQ ID NO: 21809 - RNA, 15 nt, synthetic construct
  misc_feature 1..15: note = derived and/or modified sequence opt2 from anti-influenza_CDR
  source 1..15: mol_type = other RNA
cactacttctggtcc

SEQ ID NO: 21810 - RNA, 15 nt, synthetic construct
  misc_feature 1..15: note = derived and/or modified sequence opt2 from anti-influenza_CDR
  source 1..15: mol_type = other RNA
gactactactggacc

SEQ ID NO: 21811 - RNA, 15 nt, synthetic construct
  misc_feature 1..15: note = derived and/or modified sequence opt2 from anti-influenza_CDR
  source 1..15: mol_type = other RNA
gactactactggtcc

SEQ ID NO: 21812 - RNA, 15 nt, synthetic construct
  misc_feature 1..15: note = derived and/or modified sequence opt2 from anti-influenza_CDR
  source 1..15: mol_type = other RNA
ggctactacatgcac

SEQ ID NO: 21813 - RNA, 15 nt, synthetic construct
  misc_feature 1..15: note = derived and/or modified sequence opt2 from anti-influenza_CDR
  source 1..15: mol_type = other RNA
tcccactactggtcc

SEQ ID NO: 21814 - RNA, 15 nt, synthetic construct
  misc_feature 1..15: note = derived and/or modified sequence opt2 from anti-influenza_CDR
  source 1..15: mol_type = other RNA
aactactggatcggc

SEQ ID NO: 21815 - RNA, 15 nt, synthetic construct
  misc_feature 1..15: note = derived and/or modified sequence opt2 from anti-influenza_CDR
  source 1..15: mol_type = other RNA
aactacgccatcatc

SEQ ID NO: 21816 - RNA, 15 nt, synthetic construct
  misc_feature 1..15: note = derived and/or modified sequence opt2 from anti-influenza_CDR
  source 1..15: mol_type = other RNA
gactactacatccac

SEQ ID NO: 21817 - RNA, 15 nt, synthetic construct
  misc_feature 1..15: note = derived and/or modified sequence opt2 from anti-influenza_CDR
  source 1..15: mol_type = other RNA
ggctacgacatgcac

SEQ ID NO: 21818 - RNA, 15 nt, synthetic construct
  misc_feature 1..15: note = derived and/or modified sequence opt2 from anti-influenza_CDR
  source 1..15: mol_type = other RNA
ggctactacatccac

SEQ ID NO: 21819 - RNA, 15 nt, synthetic construct
  misc_feature 1..15: note = derived and/or modified sequence opt2 from anti-influenza_CDR
  source 1..15: mol_type = other RNA
ggctactacgtccac

SEQ ID NO: 21820 - RNA, 15 nt, synthetic construct
  misc_feature 1..15: note = derived and/or modified sequence opt2 from anti-influenza_CDR
  source 1..15: mol_type = other RNA
aactactggatgtcc

SEQ ID NO: 21821 - RNA, 15 nt, synthetic construct
  misc_feature 1..15: note = derived and/or modified sequence opt2 from anti-influenza_CDR
  source 1..15: mol_type = other RNA
ggcgagtccaccctc

SEQ ID NO: 21822 - RNA, 15 nt, synthetic construct
  misc_feature 1..15: note = derived and/or modified sequence opt2 from anti-influenza_CDR
  source 1..15: mol_type = other RNA
aactactactggtcc

SEQ ID NO: 21823 - RNA, 15 nt, synthetic construct
  misc_feature 1..15: note = derived and/or modified sequence opt2 from anti-influenza_CDR
  source 1..15: mol_type = other RNA
tccaactacatgtcc

SEQ ID NO: 21824 - RNA, 15 nt, synthetic construct
  misc_feature 1..15: note = derived and/or modified sequence opt2 from anti-influenza_CDR
  source 1..15: mol_type = other RNA
tccgactactggtcc

SEQ ID NO: 21825 - RNA, 15 nt, synthetic construct
  misc_feature 1..15: note = derived and/or modified sequence opt2 from anti-influenza_CDR
  source 1..15: mol_type = other RNA
tcctacaactggatc

SEQ ID NO: 21826 - RNA, 15 nt, synthetic construct
  misc_feature 1..15: note = derived and/or modified sequence opt2 from anti-influenza_CDR
  source 1..15: mol_type = other RNA
tccacctacatgaac

SEQ ID NO: 21827 - RNA, 15 nt, synthetic construct
  misc_feature 1..15: note = derived and/or modified sequence opt2 from anti-influenza_CDR
  source 1..15: mol_type = other RNA
aactacgccatgtcc

SEQ ID NO: 21828 - RNA, 15 nt, synthetic construct
  misc_feature 1..15: note = derived and/or modified sequence opt2 from anti-influenza_CDR
  source 1..15: mol_type = other RNA
tccgacttctggtcc

SEQ ID NO: 21829 - RNA, 15 nt, synthetic construct
  misc_feature 1..15: note = derived and/or modified sequence opt2 from anti-influenza_CDR
  source 1..15: mol_type = other RNA
tactacgccatgtcc

SEQ ID NO: 21830 - RNA, 15 nt, synthetic construct
  misc_feature 1..15: note = derived and/or modified sequence opt2 from anti-influenza_CDR
  source 1..15: mol_type = other RNA
ggctactacgtctac

SEQ ID NO: 21831 - RNA, 15 nt, synthetic construct
  misc_feature 1..15: note = derived and/or modified sequence opt2 from anti-influenza_CDR
  source 1..15: mol_type = other RNA
tcctacgccatctcc

SEQ ID NO: 21832 - RNA, 15 nt, synthetic construct
  misc_feature 1..15: note = derived and/or modified sequence opt2 from anti-influenza_CDR
  source 1..15: mol_type = other RNA
tcctactcctggtcc

SEQ ID NO: 21833 - RNA, 15 nt, synthetic construct
  misc_feature 1..15: note = derived and/or modified sequence opt2 from anti-influenza_CDR
  source 1..15: mol_type = other RNA
aactccttctggggc

SEQ ID NO: 21834 - RNA, 15 nt, synthetic construct
  misc_feature 1..15: note = derived and/or modified sequence opt2 from anti-influenza_CDR
  source 1..15: mol_type = other RNA
gcctaccactggtcc

SEQ ID NO: 21835 - RNA, 15 nt, synthetic construct
  misc_feature 1..15: note = derived and/or modified sequence opt2 from anti-influenza_CDR
  source 1..15: mol_type = other RNA
gacaactacatcaac

SEQ ID NO: 21836 - RNA, 15 nt, synthetic construct
  misc_feature 1..15: note = derived and/or modified sequence opt2 from anti-influenza_CDR
  source 1..15: mol_type = other RNA
tccggcttctccgtc

SEQ ID NO: 21837 - RNA, 15 nt, synthetic construct
  misc_feature 1..15: note = derived and/or modified sequence opt2 from anti-influenza_CDR
  source 1..15: mol_type = other RNA
gcctacgccttcacc

SEQ ID NO: 21838 - RNA, 15 nt, synthetic construct
  misc_feature 1..15: note = derived and/or modified sequence opt2 from anti-influenza_CDR
  source 1..15: mol_type = other RNA
ggctccgccatctcc

SEQ ID NO: 21839 - RNA, 15 nt, synthetic construct
  misc_feature 1..15: note = derived and/or modified sequence opt2 from anti-influenza_CDR
  source 1..15: mol_type = other RNA
tcctacgccatcacc

SEQ ID NO: 21840 - RNA, 15 nt, synthetic construct
  misc_feature 1..15: note = derived and/or modified sequence opt2 from anti-influenza_CDR
  source 1..15: mol_type = other RNA
tcctactacatgcac

SEQ ID NO: 21841 - RNA, 15 nt, synthetic construct
  misc_feature 1..15: note = derived and/or modified sequence opt2 from anti-influenza_CDR
  source 1..15: mol_type = other RNA
atctacgccatgtcc

SEQ ID NO: 21842 - RNA, 15 nt, synthetic construct
  misc_feature 1..15: note = derived and/or modified sequence opt2 from anti-influenza_CDR
  source 1..15: mol_type = other RNA
tcctactccatgaac

SEQ ID NO: 21843 - RNA, 15 nt, synthetic construct
  misc_feature 1..15: note = derived and/or modified sequence opt2 from anti-influenza_CDR
  source 1..15: mol_type = other RNA
tcctacggcatctcc

SEQ ID NO: 21844 - RNA, 15 nt, synthetic construct
  misc_feature 1..15: note = derived and/or modified sequence opt2 from anti-influenza_CDR
  source 1..15: mol_type = other RNA
ttctactccatgtcc

SEQ ID NO: 21845 - RNA, 15 nt, synthetic construct
  misc_feature 1..15: note = derived and/or modified sequence opt2 from anti-influenza_CDR
  source 1..15: mol_type = other RNA
acccacgccatctcc

SEQ ID NO: 21846 - RNA, 15 nt, synthetic construct
  misc_feature 1..15: note = derived and/or modified sequence opt2 from anti-influenza_CDR
  source 1..15: mol_type = other RNA
ggctacgccatctcc

SEQ ID NO: 21847 - RNA, 15 nt, synthetic construct
  misc_feature 1..15: note = derived and/or modified sequence opt2 from anti-influenza_CDR
  source 1..15: mol_type = other RNA
tccaactccatctcc

SEQ ID NO: 21848 - RNA, 15 nt, synthetic construct
  misc_feature 1..15: note = derived and/or modified sequence opt2 from anti-influenza_CDR
  source 1..15: mol_type = other RNA
aacttcgccatcaac

SEQ ID NO: 21849 - RNA, 15 nt, synthetic construct
  misc_feature 1..15: note = derived and/or modified sequence opt2 from anti-influenza_CDR
  source 1..15: mol_type = other RNA
tccaacgccgtctcc

SEQ ID NO: 21850 - RNA, 15 nt, synthetic construct
  misc_feature 1..15: note = derived and/or modified sequence opt2 from anti-influenza_CDR
  source 1..15: mol_type = other RNA
gacaacgccatctcc

SEQ ID NO: 21851 - RNA, 15 nt, synthetic construct
  misc_feature 1..15: note = derived and/or modified sequence opt2 from anti-influenza_CDR
  source 1..15: mol_type = other RNA
ttctccgaggtcgag

SEQ ID NO: 21852 - RNA, 15 nt, synthetic construct
  misc_feature 1..15: note = derived and/or modified sequence opt2 from anti-influenza_CDR
  source 1..15: mol_type = other RNA
gcccaccacatgcac

SEQ ID NO: 21853 - RNA, 15 nt, synthetic construct
  misc_feature 1..15: note = derived and/or modified sequence opt2 from anti-influenza_CDR
  source 1..15: mol_type = other RNA
tcccagtggatcggc

SEQ ID NO: 21854 - RNA, 15 nt, synthetic construct
  misc_feature 1..15: note = derived and/or modified sequence opt2 from anti-influenza_CDR
  source 1..15: mol_type = other RNA
gactacgccatgaac

SEQ ID NO: 21855 - RNA, 15 nt, synthetic construct
  misc_feature 1..15: note = derived and/or modified sequence opt2 from anti-influenza_CDR
  source 1..15: mol_type = other RNA
aacgcctggatgtcc

SEQ ID NO: 21856 - RNA, 15 nt, synthetic construct
  misc_feature 1..15: note = derived and/or modified sequence opt2 from anti-influenza_CDR
  source 1..15: mol_type = other RNA
gactacgccatcaac

SEQ ID NO: 21857 - RNA, 15 nt, synthetic construct
  misc_feature 1..15: note = derived and/or modified sequence opt2 from anti-influenza_CDR
  source 1..15: mol_type = other RNA
cgccacggcatctcc

SEQ ID NO: 21858 - RNA, 15 nt, synthetic construct
  misc_feature 1..15: note = derived and/or modified sequence opt2 from anti-influenza_CDR
  source 1..15: mol_type = other RNA
gagctctccatccac

SEQ ID NO: 21859 - RNA, 15 nt, synthetic construct
  misc_feature 1..15: note = derived and/or modified sequence opt2 from anti-influenza_CDR
  source 1..15: mol_type = other RNA
tcctccaactactac

SEQ ID NO: 21860 - RNA, 15 nt, synthetic construct
  misc_feature 1..15: note = derived and/or modified sequence opt2 from anti-influenza_CDR
  source 1..15: mol_type = other RNA
acctacgccatgtcc

SEQ ID NO: 21861 - RNA, 15 nt, synthetic construct
  misc_feature 1..15: note = derived and/or modified sequence opt2 from anti-influenza_CDR
  source 1..15: mol_type = other RNA
aactacgccatctcc

SEQ ID NO: 21862 - RNA, 18 nt, synthetic construct
  misc_feature 1..18: note = derived and/or modified sequence opt2 from anti-influenza_CDR
  source 1..18: mol_type = other RNA
ttcggcgccatcgccggc

SEQ ID NO: 21863 - RNA, 18 nt, synthetic construct
  misc_feature 1..18: note = derived and/or modified sequence opt2 from anti-influenza_CDR
  source 1..18: mol_type = other RNA
caggacatctcccgctac

SEQ ID NO: 21864 - RNA, 18 nt, synthetic construct
  misc_feature 1..18: note = derived and/or modified sequence opt2 from anti-influenza_CDR
  source 1..18: mol_type = other RNA
cagaacatcggcccctgg

SEQ ID NO: 21865 - RNA, 18 nt, synthetic construct
  misc_feature 1..18: note = derived and/or modified sequence opt2 from anti-influenza_CDR
  source 1..18: mol_type = other RNA
cagtccgtcaaccgccgc

SEQ ID NO: 21866 - RNA, 18 nt, synthetic construct
  misc_feature 1..18: note = derived and/or modified sequence opt2 from anti-influenza_CDR
  source 1..18: mol_type = other RNA
cagtccatctccacctac

SEQ ID NO: 21867 - RNA, 18 nt, synthetic construct
  misc_feature 1..18: note = derived and/or modified sequence opt2 from anti-influenza_CDR
  source 1..18: mol_type = other RNA
cagggcatcatcacctac

SEQ ID NO: 21868 - RNA, 18 nt, synthetic construct
  misc_feature 1..18: note = derived and/or modified sequence opt2 from anti-influenza_CDR
  source 1..18: mol_type = other RNA
cagggcatctcctcctac

SEQ ID NO: 21869 - RNA, 18 nt, synthetic construct
  misc_feature 1..18: note = derived and/or modified sequence opt2 from anti-influenza_CDR
  source 1..18: mol_type = other RNA
caggacgtctccacctgg

SEQ ID NO: 21870 - RNA, 18 nt, synthetic construct
  misc_feature 1..18: note = derived and/or modified sequence opt2 from anti-influenza_CDR
  source 1..18: mol_type = other RNA
caggacatctacatctac

SEQ ID NO: 21871 - RNA, 18 nt, synthetic construct
  misc_feature 1..18: note = derived and/or modified sequence opt2 from anti-influenza_CDR
  source 1..18: mol_type = other RNA
gagaacatctggaacaac

SEQ ID NO: 21872 - RNA, 18 nt, synthetic construct
  misc_feature 1..18: note = derived and/or modified sequence opt2 from anti-influenza_CDR
  source 1..18: mol_type = other RNA
ggcttcaccgtcacctcc

SEQ ID NO: 21873 - RNA, 18 nt, synthetic construct
  misc_feature 1..18: note = derived and/or modified sequence opt2 from anti-influenza_CDR
  source 1..18: mol_type = other RNA
caggacatctccggccac

SEQ ID NO: 21874 - RNA, 18 nt, synthetic construct
  misc_feature 1..18: note = derived and/or modified sequence opt2 from anti-influenza_CDR
  source 1..18: mol_type = other RNA
tccctcctcaccgaggtc

SEQ ID NO: 21875 - RNA, 18 nt, synthetic construct
  misc_feature 1..18: note = derived and/or modified sequence opt2 from anti-influenza_CDR
  source 1..18: mol_type = other RNA
ggctcctccatctccaac

SEQ ID NO: 21876 - RNA, 18 nt, synthetic construct
  misc_feature 1..18: note = derived and/or modified sequence opt2 from anti-influenza_CDR
  source 1..18: mol_type = other RNA
ggcggctccatcacctcc

SEQ ID NO: 21877 - RNA, 18 nt, synthetic construct
  misc_feature 1..18: note = derived and/or modified sequence opt2 from anti-influenza_CDR
  source 1..18: mol_type = other RNA
ggcggctccatctcctcc

SEQ ID NO: 21878 - RNA, 18 nt, synthetic construct
  misc_feature 1..18: note = derived and/or modified sequence opt2 from anti-influenza_CDR
  source 1..18: mol_type = other RNA
ggcctctccgtctcctcc

SEQ ID NO: 21879 - RNA, 18 nt, synthetic construct
  misc_feature 1..18: note = derived and/or modified sequence opt2 from anti-influenza_CDR
  source 1..18: mol_type = other RNA
ggcgcctccatctcctcc

SEQ ID NO: 21880 - RNA, 18 nt, synthetic construct
  misc_feature 1..18: note = derived and/or modified sequence opt2 from anti-influenza_CDR
  source 1..18: mol_type = other RNA
ggcgactccatctcctcc

SEQ ID NO: 21881 - RNA, 18 nt, synthetic construct
  misc_feature 1..18: note = derived and/or modified sequence opt2 from anti-influenza_CDR
  source 1..18: mol_type = other RNA
ggcggctccatctccaac

SEQ ID NO: 21882 - RNA, 18 nt, synthetic construct
  misc_feature 1..18: note = derived and/or modified sequence opt2 from anti-influenza_CDR
  source 1..18: mol_type = other RNA
ggcggctccatctccgcc

SEQ ID NO: 21883 - RNA, 18 nt, synthetic construct
  misc_feature 1..18: note = derived and/or modified sequence opt2 from anti-influenza_CDR
  source 1..18: mol_type = other RNA
ggcttctccgtctccgac

SEQ ID NO: 21884 - RNA, 18 nt, synthetic construct
  misc_feature 1..18: note = derived and/or modified sequence opt2 from anti-influenza_CDR
  source 1..18: mol_type = other RNA
tcccgctccctcgacgtc

SEQ ID NO: 21885 - RNA, 18 nt, synthetic construct
  misc_feature 1..18: note = derived and/or modified sequence opt2 from anti-influenza_CDR
  source 1..18: mol_type = other RNA
cgctcccagcagaccgtc

SEQ ID NO: 21886 - RNA, 18 nt, synthetic construct
  misc_feature 1..18: note = derived and/or modified sequence opt2 from anti-influenza_CDR
  source 1..18: mol_type = other RNA
cagaccatcaacaactac

SEQ ID NO: 21887 - RNA, 18 nt, synthetic construct
  misc_feature 1..18: note = derived and/or modified sequence opt2 from anti-influenza_CDR
  source 1..18: mol_type = other RNA
aacatgggccccacctcc

SEQ ID NO: 21888 - RNA, 18 nt, synthetic construct
  misc_feature 1..18: note = derived and/or modified sequence opt2 from anti-influenza_CDR
  source 1..18: mol_type = other RNA
caggtcgtcggcaccaac

SEQ ID NO: 21889 - RNA, 18 nt, synthetic construct
  misc_feature 1..18: note = derived and/or modified sequence opt2 from anti-influenza_CDR
  source 1..18: mol_type = other RNA
cagggcatcaacacccac

SEQ ID NO: 21890 - RNA, 18 nt, synthetic construct
  misc_feature 1..18: note = derived and/or modified sequence opt2 from anti-influenza_CDR
  source 1..18: mol_type = other RNA
caggacatccgcaaccgc

SEQ ID NO: 21891 - RNA, 18 nt, synthetic construct
  misc_feature 1..18: note = derived and/or modified sequence opt2 from anti-influenza_CDR
  source 1..18: mol_type = other RNA
cagggcatcggctccaac

SEQ ID NO: 21892 - RNA, 18 nt, synthetic construct
  misc_feature 1..18: note = derived and/or modified sequence opt2 from anti-influenza_CDR
  source 1..18: mol_type = other RNA
cagaccatctaccgctgg

SEQ ID NO: 21893 - RNA, 18 nt, synthetic construct
  misc_feature 1..18: note = derived and/or modified sequence opt2 from anti-influenza_CDR
  source 1..18: mol_type = other RNA
cagaccatcacccgcttc

SEQ ID NO: 21894 - RNA, 18 nt, synthetic construct
  misc_feature 1..18: note = derived and/or modified sequence opt2 from anti-influenza_CDR
  source 1..18: mol_type = other RNA
cgcctcggcgagaagttc

SEQ ID NO: 21895 - RNA, 18 nt, synthetic construct
  misc_feature 1..18: note = derived and/or modified sequence opt2 from anti-influenza_CDR
  source 1..18: mol_type = other RNA
aagctcggcgacaagttc

SEQ ID NO: 21896 - RNA, 18 nt, synthetic construct
  misc_feature 1..18: note = derived and/or modified sequence opt2 from anti-influenza_CDR
  source 1..18: mol_type = other RNA
cagggcctcggctccaac

SEQ ID NO: 21897 - RNA, 18 nt, synthetic construct
  misc_feature 1..18: note = derived and/or modified sequence opt2 from anti-influenza_CDR
  source 1..18: mol_type = other RNA
tacatcggctccaagtcc

SEQ ID NO: 21898 - RNA, 18 nt, synthetic construct
  misc_feature 1..18: note = derived and/or modified sequence opt2 from anti-influenza_CDR
  source 1..18: mol_type = other RNA
cagctcatctcctcctac

SEQ ID NO: 21899 - RNA, 18 nt, synthetic construct
  misc_feature 1..18: note = derived and/or modified sequence opt2 from anti-influenza_CDR
  source 1..18: mol_type = other RNA
cagtccgtctcctccaac

SEQ ID NO: 21900 - RNA, 18 nt, synthetic construct
  misc_feature 1..18: note = derived and/or modified sequence opt2 from anti-influenza_CDR
  source 1..18: mol_type = other RNA
caggtcatctcctcctac

SEQ ID NO: 21901 - RNA, 18 nt, synthetic construct
  misc_feature 1..18: note = derived and/or modified sequence opt2 from anti-influenza_CDR
  source 1..18: mol_type = other RNA
cagtccgtcaaccgcaac

SEQ ID NO: 21902 - RNA, 18 nt, synthetic construct
  misc_feature 1..18: note = derived and/or modified sequence opt2 from anti-influenza_CDR
  source 1..18: mol_type = other RNA
gacatcggctccaagtcc

SEQ ID NO: 21903 - RNA, 18 nt, synthetic construct
  misc_feature 1..18: note = derived and/or modified sequence opt2 from anti-influenza_CDR
  source 1..18: mol_type = other RNA
cagtccgtctccaccaac

SEQ ID NO: 21904 - RNA, 18 nt, synthetic construct
  misc_feature 1..18: note = derived and/or modified sequence opt2 from anti-influenza_CDR
  source 1..18: mol_type = other RNA
atgatcgccggctggcac

SEQ ID NO: 21905 - RNA, 18 nt, synthetic construct
  misc_feature 1..18: note = derived and/or modified sequence opt2 from anti-influenza_CDR
  source 1..18: mol_type = other RNA
caggacatctccacctgg

SEQ ID NO: 21906 - RNA, 18 nt, synthetic construct
  misc_feature 1..18: note = derived and/or modified sequence opt2 from anti-influenza_CDR
  source 1..18: mol_type = other RNA
gagaagatctactccaac

SEQ ID NO: 21907 - RNA, 21 nt, synthetic construct
  misc_feature 1..21: note = derived and/or modified sequence opt2 from anti-influenza_CDR
  source 1..21: mol_type = other RNA
atctactacaactacaacatc

SEQ ID NO: 21908 - RNA, 21 nt, synthetic construct
  misc_feature 1..21: note = derived and/or modified sequence opt2 from anti-influenza_CDR
  source 1..21: mol_type = other RNA
cagtccatctcctccggctac

SEQ ID NO: 21909 - RNA, 21 nt, synthetic construct
  misc_feature 1..21: note = derived and/or modified sequence opt2 from anti-influenza_CDR
  source 1..21: mol_type = other RNA
cagtccgtctcctcctcctac

SEQ ID NO: 21910 - RNA, 21 nt, synthetic construct
  misc_feature 1..21: note = derived and/or modified sequence opt2 from anti-influenza_CDR
  source 1..21: mol_type = other RNA
cagaccgtctcctcctcctac

SEQ ID NO: 21911 - RNA, 21 nt, synthetic construct
  misc_feature 1..21: note = derived and/or modified sequence opt2 from anti-influenza_CDR
  source 1..21: mol_type = other RNA
tccaacaacgccgtctggaac

SEQ ID NO: 21912 - RNA, 21 nt, synthetic construct
  misc_feature 1..21: note = derived and/or modified sequence opt2 from anti-influenza_CDR
  source 1..21: mol_type = other RNA
tccaactccgccgtctggaac

SEQ ID NO: 21913 - RNA, 21 nt, synthetic construct
  misc_feature 1..21: note = derived and/or modified sequence opt2 from anti-influenza_CDR
  source 1..21: mol_type = other RNA
gccgccaccaccctccagtcc

SEQ ID NO: 21914 - RNA, 21 nt, synthetic construct
  misc_feature 1..21: note = derived and/or modified sequence opt2 from anti-influenza_CDR
  source 1..21: mol_type = other RNA
tccaaccgcgccacctggaac

SEQ ID NO: 21915 - RNA, 21 nt, synthetic construct
  misc_feature 1..21: note = derived and/or modified sequence opt2 from anti-influenza_CDR
  source 1..21: mol_type = other RNA
gccacctccaccctccagtcc

SEQ ID NO: 21916 - RNA, 21 nt, synthetic construct
  misc_feature 1..21: note = derived and/or modified sequence opt2 from anti-influenza_CDR
  source 1..21: mol_type = other RNA
tccaactccgccacctggaac

SEQ ID NO: 21917 - RNA, 21 nt, synthetic construct
  misc_feature 1..21: note = derived and/or modified sequence opt2 from anti-influenza_CDR
  source 1..21: mol_type = other RNA
gcctcctccaccctccagtcc

SEQ ID NO: 21918 - RNA, 21 nt, synthetic construct
  misc_feature 1..21: note = derived and/or modified sequence opt2 from anti-influenza_CDR
  source 1..21: mol_type = other RNA
tcctacaacgccgtctggaac

SEQ ID NO: 21919 - RNA, 21 nt, synthetic construct
  misc_feature 1..21: note = derived and/or modified sequence opt2 from anti-influenza_CDR
  source 1..21: mol_type = other RNA
gccgcctcctcccgcctctcc

SEQ ID NO: 21920 - RNA, 21 nt, synthetic construct
  misc_feature 1..21: note = derived and/or modified sequence opt2 from anti-influenza_CDR
  source 1..21: mol_type = other RNA
gccgcctcctcccgcggctcc

SEQ ID NO: 21921 - RNA, 21 nt, synthetic construct
  misc_feature 1..21: note = derived and/or modified sequence opt2 from anti-influenza_CDR
  source 1..21: mol_type = other RNA
atctaccactccggctccgcc

SEQ ID NO: 21922 - RNA, 21 nt, synthetic construct
  misc_feature 1..21: note = derived and/or modified sequence opt2 from anti-influenza_CDR
  source 1..21: mol_type = other RNA
atctactactccggcgtcacc

SEQ ID NO: 21923 - RNA, 21 nt, synthetic construct
  misc_feature 1..21: note = derived and/or modified sequence opt2 from anti-influenza_CDR
  source 1..21: mol_type = other RNA
tcctcctacctcgcctggtac

SEQ ID NO: 21924 - RNA, 21 nt, synthetic construct
  misc_feature 1..21: note = derived and/or modified sequence opt2 from anti-influenza_CDR
  source 1..21: mol_type = other RNA
cagtccctctcctcctcctcc

SEQ ID NO: 21925 - RNA, 21 nt, synthetic construct
  misc_feature 1..21: note = derived and/or modified sequence opt2 from anti-influenza_CDR
  source 1..21: mol_type = other RNA
cagtccgtctccatctcctac

SEQ ID NO: 21926 - RNA, 21 nt, synthetic construct
  misc_feature 1..21: note = derived and/or modified sequence opt2 from anti-influenza_CDR
  source 1..21: mol_type = other RNA
gacgtcaccgagcgcccctcc

SEQ ID NO: 21927 - RNA, 21 nt, synthetic construct
  misc_feature 1..21: note = derived and/or modified sequence opt2 from anti-influenza_CDR
  source 1..21: mol_type = other RNA
gccgcctccaccctcctcgac

SEQ ID NO: 21928 - RNA, 21 nt, synthetic construct
  misc_feature 1..21: note = derived and/or modified sequence opt2 from anti-influenza_CDR
  source 1..21: mol_type = other RNA
gccgcctccaccctccactcc

SEQ ID NO: 21929 - RNA, 21 nt, synthetic construct
  misc_feature 1..21: note = derived and/or modified sequence opt2 from anti-influenza_CDR
  source 1..21: mol_type = other RNA
ggcgcctcctccctccagggc

SEQ ID NO: 21930 - RNA, 21 nt, synthetic construct
  misc_feature 1..21: note = derived and/or modified sequence opt2 from anti-influenza_CDR
  source 1..21: mol_type = other RNA
accaacggcgtcaacgtcggc

SEQ ID NO: 21931 - RNA, 21 nt, synthetic construct
  misc_feature 1..21: note = derived and/or modified sequence opt2 from anti-influenza_CDR
  source 1..21: mol_type = other RNA
gacgcctccacccgcgccacc

SEQ ID NO: 21932 - RNA, 21 nt, synthetic construct
  misc_feature 1..21: note = derived and/or modified sequence opt2 from anti-influenza_CDR
  source 1..21: mol_type = other RNA
tccgagacctactactggtcc

SEQ ID NO: 21933 - RNA, 21 nt, synthetic construct
  misc_feature 1..21: note = derived and/or modified sequence opt2 from anti-influenza_CDR
  source 1..21: mol_type = other RNA
gaggccgtcaacctcgagtcc

SEQ ID NO: 21934 - RNA, 21 nt, synthetic construct
  misc_feature 1..21: note = derived and/or modified sequence opt2 from anti-influenza_CDR
  source 1..21: mol_type = other RNA
ggcgcctccacccgcgccacc

SEQ ID NO: 21935 - RNA, 21 nt, synthetic construct
  misc_feature 1..21: note = derived and/or modified sequence opt2 from anti-influenza_CDR
  source 1..21: mol_type = other RNA
gtctccggctactactggtcc

SEQ ID NO: 21936 - RNA, 21 nt, synthetic construct
  misc_feature 1..21: note = derived and/or modified sequence opt2 from anti-influenza_CDR
  source 1..21: mol_type = other RNA
atcaccggcgtccgcgtcggc

SEQ ID NO: 21937 - RNA, 21 nt, synthetic construct
  misc_feature 1..21: note = derived and/or modified sequence opt2 from anti-influenza_CDR
  source 1..21: mol_type = other RNA
gacgcctccaaccgcgccacc

SEQ ID NO: 21938 - RNA, 21 nt, synthetic construct
  misc_feature 1..21: note = derived and/or modified sequence opt2 from anti-influenza_CDR
  source 1..21: mol_type = other RNA
gaggtcaccaactggccctcc

SEQ ID NO: 21939 - RNA, 21 nt, synthetic construct
  misc_feature 1..21: note = derived and/or modified sequence opt2 from anti-influenza_CDR
  source 1..21: mol_type = other RNA
aaggactccgagcgcccctcc

SEQ ID NO: 21940 - RNA, 21 nt, synthetic construct
  misc_feature 1..21: note = derived and/or modified sequence opt2 from anti-influenza_CDR
  source 1..21: mol_type = other RNA
tccggcaactactactggaac

SEQ ID NO: 21941 - RNA, 21 nt, synthetic construct
  misc_feature 1..21: note = derived and/or modified sequence opt2 from anti-influenza_CDR
  source 1..21: mol_type = other RNA
tccaccaccatccgccactcc

SEQ ID NO: 21942 - RNA, 21 nt, synthetic construct
  misc_feature 1..21: note = derived and/or modified sequence opt2 from anti-influenza_CDR
  source 1..21: mol_type = other RNA
gacgactccggccgcccctcc

SEQ ID NO: 21943 - RNA, 21 nt, synthetic construct
  misc_feature 1..21: note = derived and/or modified sequence opt2 from anti-influenza_CDR
  source 1..21: mol_type = other RNA
cgcaacgacctccgcccctcc

SEQ ID NO: 21944 - RNA, 21 nt, synthetic construct
  misc_feature 1..21: note = derived and/or modified sequence opt2 from anti-influenza_CDR
  source 1..21: mol_type = other RNA
tccgtcgaccactactggtcc

SEQ ID NO: 21945 - RNA, 21 nt, synthetic construct
  misc_feature 1..21: note = derived and/or modified sequence opt2 from anti-influenza_CDR
  source 1..21: mol_type = other RNA
gccgtctccatcctccagtcc

SEQ ID NO: 21946 - RNA, 21 nt, synthetic construct
  misc_feature 1..21: note = derived and/or modified sequence opt2 from anti-influenza_CDR
  source 1..21: mol_type = other RNA
gacgacaccgaccgcccctcc

SEQ ID NO: 21947 - RNA, 21 nt, synthetic construct
  misc_feature 1..21: note = derived and/or modified sequence opt2 from anti-influenza_CDR
  source 1..21: mol_type = other RNA
gagaacaacaagcgcccctcc

SEQ ID NO: 21948 - RNA, 21 nt, synthetic construct
  misc_feature 1..21: note = derived and/or modified sequence opt2 from anti-influenza_CDR
  source 1..21: mol_type = other RNA
gactcctccaaccgcgccccc

SEQ ID NO: 21949 - RNA, 21 nt, synthetic construct
  misc_feature 1..21: note = derived and/or modified sequence opt2 from anti-influenza_CDR
  source 1..21: mol_type = other RNA
gaggtcaccaagcgcccctcc

SEQ ID NO: 21950 - RNA, 21 nt, synthetic construct
  misc_feature 1..21: note = derived and/or modified sequence opt2 from anti-influenza_CDR
  source 1..21: mol_type = other RNA
gccacctccaacacccactcc

SEQ ID NO: 21951 - RNA, 21 nt, synthetic construct
  misc_feature 1..21: note = derived and/or modified sequence opt2 from anti-influenza_CDR
  source 1..21: mol_type = other RNA
gccgcctccaacctcgagaac

SEQ ID NO: 21952 - RNA, 21 nt, synthetic construct
  misc_feature 1..21: note = derived and/or modified sequence opt2 from anti-influenza_CDR
  source 1..21: mol_type = other RNA
gccgcctccggcctccagtcc

SEQ ID NO: 21953 - RNA, 21 nt, synthetic construct
  misc_feature 1..21: note = derived and/or modified sequence opt2 from anti-influenza_CDR
  source 1..21: mol_type = other RNA
ggcttcaccgtctcctccaac

SEQ ID NO: 21954 - RNA, 21 nt, synthetic construct
  misc_feature 1..21: note = derived and/or modified sequence opt2 from anti-influenza_CDR
  source 1..21: mol_type = other RNA
ggcggcggctactcctggaac

SEQ ID NO: 21955 - RNA, 21 nt, synthetic construct
  misc_feature 1..21: note = derived and/or modified sequence opt2 from anti-influenza_CDR
  source 1..21: mol_type = other RNA
ggcgcctccaacctccagtcc

SEQ ID NO: 21956 - RNA, 21 nt, synthetic construct
  misc_feature 1..21: note = derived and/or modified sequence opt2 from anti-influenza_CDR
  source 1..21: mol_type = other RNA
ggcgccaccaacctccagtcc

SEQ ID NO: 21957 - RNA, 21 nt, synthetic construct
  misc_feature 1..21: note = derived and/or modified sequence opt2 from anti-influenza_CDR
  source 1..21: mol_type = other RNA
ggcgcctccaacctccactcc

SEQ ID NO: 21958 - RNA, 21 nt, synthetic construct
  misc_feature 1..21: note = derived and/or modified sequence opt2 from anti-influenza_CDR
  source 1..21: mol_type = other RNA
ggcgcctccaccctccagtcc

SEQ ID NO: 21959 - RNA, 21 nt, synthetic construct
  misc_feature 1..21: note = derived and/or modified sequence opt2 from anti-influenza_CDR
  source 1..21: mol_type = other RNA
gacaactccgaccgcccctcc

SEQ ID NO: 21960 - RNA, 21 nt, synthetic construct
  misc_feature 1..21: note = derived and/or modified sequence opt2 from anti-influenza_CDR
  source 1..21: mol_type = other RNA
ggcgcctcctccctccagtcc

SEQ ID NO: 21961 - RNA, 21 nt, synthetic construct
  misc_feature 1..21: note = derived and/or modified sequence opt2 from anti-influenza_CDR
  source 1..21: mol_type = other RNA
ggcaactccaaccgcccctcc

SEQ ID NO: 21962 - RNA, 21 nt, synthetic construct
  misc_feature 1..21: note = derived and/or modified sequence opt2 from anti-influenza_CDR
  source 1..21: mol_type = other RNA
gccgcctcctccctccagtcc

SEQ ID NO: 21963 - RNA, 21 nt, synthetic construct
  misc_feature 1..21: note = derived and/or modified sequence opt2 from anti-influenza_CDR
  source 1..21: mol_type = other RNA
gccgcctcctccctccactcc

SEQ ID NO: 21964 - RNA, 21 nt, synthetic construct
  misc_feature 1..21: note = derived and/or modified sequence opt2 from anti-influenza_CDR
  source 1..21: mol_type = other RNA
ggcgcctccaccctccagaac

SEQ ID NO: 21965 - RNA, 21 nt, synthetic construct
  misc_feature 1..21: note = derived and/or modified sequence opt2 from anti-influenza_CDR
  source 1..21: mol_type = other RNA
ggcgccaccgacctccagtcc

SEQ ID NO: 21966 - RNA, 21 nt, synthetic construct
  misc_feature 1..21: note = derived and/or modified sequence opt2 from anti-influenza_CDR
  source 1..21: mol_type = other RNA
tccggcgcctactactggacc

SEQ ID NO: 21967 - RNA, 21 nt, synthetic construct
  misc_feature 1..21: note = derived and/or modified sequence opt2 from anti-influenza_CDR
  source 1..21: mol_type = other RNA
gtctccgacaactacatcaac

SEQ ID NO: 21968 - RNA, 21 nt, synthetic construct
  misc_feature 1..21: note = derived and/or modified sequence opt2 from anti-influenza_CDR
  source 1..21: mol_type = other RNA
tgggcctccacccgcgagtcc

SEQ ID NO: 21969 - RNA, 21 nt, synthetic construct
  misc_feature 1..21: note = derived and/or modified sequence opt2 from anti-influenza_CDR
  source 1..21: mol_type = other RNA
tccaacaaccagcgcccctcc

SEQ ID NO: 21970 - RNA, 21 nt, synthetic construct
  misc_feature 1..21: note = derived and/or modified sequence opt2 from anti-influenza_CDR
  source 1..21: mol_type = other RNA
gaggtctccaaccgcccctcc

SEQ ID NO: 21971 - RNA, 21 nt, synthetic construct
  misc_feature 1..21: note = derived and/or modified sequence opt2 from anti-influenza_CDR
  source 1..21: mol_type = other RNA
aagaacacccagcgcccctcc

SEQ ID NO: 21972 - RNA, 21 nt, synthetic construct
  misc_feature 1..21: note = derived and/or modified sequence opt2 from anti-influenza_CDR
  source 1..21: mol_type = other RNA
gacaacaacaagcgcccctcc

SEQ ID NO: 21973 - RNA, 21 nt, synthetic construct
  misc_feature 1..21: note = derived and/or modified sequence opt2 from anti-influenza_CDR
  source 1..21: mol_type = other RNA
gacgcctccaccctccgctcc

SEQ ID NO: 21974 - RNA, 21 nt, synthetic construct
  misc_feature 1..21: note = derived and/or modified sequence opt2 from anti-influenza_CDR
  source 1..21: mol_type = other RNA
caggacaaccgccgcccctcc

SEQ ID NO: 21975 - RNA, 21 nt, synthetic construct
  misc_feature 1..21: note = derived and/or modified sequence opt2 from anti-influenza_CDR
  source 1..21: mol_type = other RNA
gacgtctccaagcgcccctcc

SEQ ID NO: 21976 - RNA, 21 nt, synthetic construct
  misc_feature 1..21: note = derived and/or modified sequence opt2 from anti-influenza_CDR
  source 1..21: mol_type = other RNA
gacgcctcctcccgcgccacc

SEQ ID NO: 21977 - RNA, 21 nt, synthetic construct
  misc_feature 1..21: note = derived and/or modified sequence opt2 from anti-influenza_CDR
  source 1..21: mol_type = other RNA
ctcggctccaaccgcgcctcc

SEQ ID NO: 21978 - RNA, 21 nt, synthetic construct
  misc_feature 1..21: note = derived and/or modified sequence opt2 from anti-influenza_CDR
  source 1..21: mol_type = other RNA
ggcgcctccacccgcgccgcc

SEQ ID NO: 21979 - RNA, 21 nt, synthetic construct
  misc_feature 1..21: note = derived and/or modified sequence opt2 from anti-influenza_CDR
  source 1..21: mol_type = other RNA
gacgactccgaccgcccctcc

SEQ ID NO: 21980 - RNA, 21 nt, synthetic construct
  misc_feature 1..21: note = derived and/or modified sequence opt2 from anti-influenza_CDR
  source 1..21: mol_type = other RNA
cgcgacggccagcgcccctcc

SEQ ID NO: 21981 - RNA, 21 nt, synthetic construct
  misc_feature 1..21: note = derived and/or modified sequence opt2 from anti-influenza_CDR
  source 1..21: mol_type = other RNA
ggcgcctcctcccgcgccacc

SEQ ID NO: 21982 - RNA, 21 nt, synthetic construct
  misc_feature 1..21: note = derived and/or modified sequence opt2 from anti-influenza_CDR
  source 1..21: mol_type = other RNA
ggcgcctcctcccgcgcctcc

SEQ ID NO: 21983 - RNA, 21 nt, synthetic construct
  misc_feature 1..21: note = derived and/or modified sequence opt2 from anti-influenza_CDR
  source 1..21: mol_type = other RNA
gccgcctccaccctccagtcc

SEQ ID NO: 21984 - RNA, 21 nt, synthetic construct
  misc_feature 1..21: note = derived and/or modified sequence opt2 from anti-influenza_CDR
  source 1..21: mol_type = other RNA
ctcgtctccaagcgcgcctcc

SEQ ID NO: 21985 - RNA, 21 nt, synthetic construct
  misc_feature 1..21: note = derived and/or modified sequence opt2 from anti-influenza_CDR
  source 1..21: mol_type = other RNA
gacgtcacctaccgcccctcc

SEQ ID NO: 21986 - RNA, 21 nt, synthetic construct
  misc_feature 1..21: note = derived and/or modified sequence opt2 from anti-influenza_CDR
  source 1..21: mol_type = other RNA
atgcaggccctcgagaccccc

SEQ ID NO: 21987 - RNA, 21 nt, synthetic construct
  misc_feature 1..21: note = derived and/or modified sequence opt2 from anti-influenza_CDR
  source 1..21: mol_type = other RNA
cagaactacggctcccccttc

SEQ ID NO: 21988 - RNA, 21 nt, synthetic construct
  misc_feature 1..21: note = derived and/or modified sequence opt2 from anti-influenza_CDR
  source 1..21: mol_type = other RNA
cagcagtacggctccctcccc

SEQ ID NO: 21989 - RNA, 21 nt, synthetic construct
  misc_feature 1..21: note = derived and/or modified sequence opt2 from anti-influenza_CDR
  source 1..21: mol_type = other RNA
tggggctcctacctcgagtcc

SEQ ID NO: 21990 - RNA, 21 nt, synthetic construct
  misc_feature 1..21: note = derived and/or modified sequence opt2 from anti-influenza_CDR
  source 1..21: mol_type = other RNA
tccgcctccacccgcgccacc

SEQ ID NO: 21991 - RNA, 21 nt, synthetic construct
  misc_feature 1..21: note = derived and/or modified sequence opt2 from anti-influenza_CDR
  source 1..21: mol_type = other RNA
ggcgcctccacccgcgcctcc

SEQ ID NO: 21992 - RNA, 21 nt, synthetic construct
  misc_feature 1..21: note = derived and/or modified sequence opt2 from anti-influenza_CDR
  source 1..21: mol_type = other RNA
ggcgcctccacccgcgacacc

SEQ ID NO: 21993 - RNA, 21 nt, synthetic construct
  misc_feature 1..21: note = derived and/or modified sequence opt2 from anti-influenza_CDR
  source 1..21: mol_type = other RNA
aaggtctccaccctcgagtcc

SEQ ID NO: 21994 - RNA, 21 nt, synthetic construct
  misc_feature 1..21: note = derived and/or modified sequence opt2 from anti-influenza_CDR
  source 1..21: mol_type = other RNA
tccaacaccgagcgcccctcc

SEQ ID NO: 21995 - RNA, 21 nt, synthetic construct
  misc_feature 1..21: note = derived and/or modified sequence opt2 from anti-influenza_CDR
  source 1..21: mol_type = other RNA
aagatctccaaccgcgactcc

SEQ ID NO: 21996 - RNA, 21 nt, synthetic construct
  misc_feature 1..21: note = derived and/or modified sequence opt2 from anti-influenza_CDR
  source 1..21: mol_type = other RNA
tccgcctcccaccgctactcc

SEQ ID NO: 21997 - RNA, 21 nt, synthetic construct
  misc_feature 1..21: note = derived and/or modified sequence opt2 from anti-influenza_CDR
  source 1..21: mol_type = other RNA
cagtccgtccgctccaacaac

SEQ ID NO: 21998 - RNA, 21 nt, synthetic construct
  misc_feature 1..21: note = derived and/or modified sequence opt2 from anti-influenza_CDR
  source 1..21: mol_type = other RNA
cagtccgtccgctccggctac

SEQ ID NO: 21999 - RNA, 21 nt, synthetic construct
  misc_feature 1..21: note = derived and/or modified sequence opt2 from anti-influenza_CDR
  source 1..21: mol_type = other RNA
atctactaccgcggctccacc

SEQ ID NO: 22000 - RNA, 21 nt, synthetic construct
  misc_feature 1..21: note = derived and/or modified sequence opt2 from anti-influenza_CDR
  source 1..21: mol_type = other RNA
gtctactactccggcatcacc

SEQ ID NO: 22001 - RNA, 21 nt, synthetic construct
  misc_feature 1..21: note = derived and/or modified sequence opt2 from anti-influenza_CDR
  source 1..21: mol_type = other RNA
tcccacttcgccaacctcaag

SEQ ID NO: 22002 - RNA, 21 nt, synthetic construct
  misc_feature 1..21: note = derived and/or modified sequence opt2 from anti-influenza_CDR
  source 1..21: mol_type = other RNA
ctcaacaagtccaagccctac

SEQ ID NO: 22003 - RNA, 21 nt, synthetic construct
  misc_feature 1..21: note = derived and/or modified sequence opt2 from anti-influenza_CDR
  source 1..21: mol_type = other RNA
aagctcgccaacaccggcacc

SEQ ID NO: 22004 - RNA, 21 nt, synthetic construct
  misc_feature 1..21: note = derived and/or modified sequence opt2 from anti-influenza_CDR
  source 1..21: mol_type = other RNA
gccgcctccaccctcacctcc

SEQ ID NO: 22005 - RNA, 21 nt, synthetic construct
  misc_feature 1..21: note = derived and/or modified sequence opt2 from anti-influenza_CDR
  source 1..21: mol_type = other RNA
gacgcctccaagctcgcctcc

SEQ ID NO: 22006 - RNA, 21 nt, synthetic construct
  misc_feature 1..21: note = derived and/or modified sequence opt2 from anti-influenza_CDR
  source 1..21: mol_type = other RNA
ttcgcctcccgcctcgcctcc

SEQ ID NO: 22007 - RNA, 21 nt, synthetic construct
  misc_feature 1..21: note = derived and/or modified sequence opt2 from anti-influenza_CDR
  source 1..21: mol_type = other RNA
tccgcctccaccctcgcctcc

SEQ ID NO: 22008 - RNA, 21 nt, synthetic construct
  misc_feature 1..21: note = derived and/or modified sequence opt2 from anti-influenza_CDR
  source 1..21: mol_type = other RNA
gaggtctcccagcgcccctcc

SEQ ID NO: 22009 - RNA, 21 nt, synthetic construct
  misc_feature 1..21: note = derived and/or modified sequence opt2 from anti-influenza_CDR
  source 1..21: mol_type = other RNA
ggcggcaccctcaacaactac

SEQ ID NO: 22010 - RNA, 21 nt, synthetic construct
  misc_feature 1..21: note = derived and/or modified sequence opt2 from anti-influenza_CDR
  source 1..21: mol_type = other RNA
gacatcgtcatgacccagtcc

SEQ ID NO: 22011 - RNA, 24 nt, synthetic construct
  misc_feature 1..24: note = derived and/or modified sequence opt2 from anti-influenza_CDR
  source 1..24: mol_type = other RNA
ggcttcaccttctccaactacgcc

SEQ ID NO: 22012 - RNA, 24 nt, synthetic construct
  misc_feature 1..24: note = derived and/or modified sequence opt2 from anti-influenza_CDR
  source 1..24: mol_type = other RNA
ggcttcaccttctccaactacggc

SEQ ID NO: 22013 - RNA, 24 nt, synthetic construct
  misc_feature 1..24: note = derived and/or modified sequence opt2 from anti-influenza_CDR
  source 1..24: mol_type = other RNA
ggcttcaccttctcctcctacgcc

SEQ ID NO: 22014 - RNA, 24 nt, synthetic construct
  misc_feature 1..24: note = derived and/or modified sequence opt2 from anti-influenza_CDR
  source 1..24: mol_type = other RNA
ggcttcaccttctccacctacgcc

SEQ ID NO: 22015 - RNA, 24 nt, synthetic construct
  misc_feature 1..24: note = derived and/or modified sequence opt2 from anti-influenza_CDR
  source 1..24: mol_type = other RNA
ggcggcatcttcatctcccaggcc

SEQ ID NO: 22016 - RNA, 24 nt, synthetic construct
  misc_feature 1..24: note = derived and/or modified sequence opt2 from anti-influenza_CDR
  source 1..24: mol_type = other RNA
ggcggcatcttctccccctacgcc

SEQ ID NO: 22017 - RNA, 24 nt, synthetic construct
  misc_feature 1..24: note = derived and/or modified sequence opt2 from anti-influenza_CDR
  source 1..24: mol_type = other RNA
ggcggccccttctccggcttcgcc

SEQ ID NO: 22018 - RNA, 24 nt, synthetic construct
  misc_feature 1..24: note = derived and/or modified sequence opt2 from anti-influenza_CDR
  source 1..24: mol_type = other RNA
ggcggcaccttcaactcccacgcc

SEQ ID NO: 22019 - RNA, 24 nt, synthetic construct
  misc_feature 1..24: note = derived and/or modified sequence opt2 from anti-influenza_CDR
  source 1..24: mol_type = other RNA
ggctccaacatcggctccaacacc

SEQ ID NO: 22020 - RNA, 24 nt, synthetic construct
  misc_feature 1..24: note = derived and/or modified sequence opt2 from anti-influenza_CDR
  source 1..24: mol_type = other RNA
ggcgtcaccttctccatgtacgcc

SEQ ID NO: 22021 - RNA, 24 nt, synthetic construct
  misc_feature 1..24: note = derived and/or modified sequence opt2 from anti-influenza_CDR
  source 1..24: mol_type = other RNA
ggcgtcaccttctccatgtacacc

SEQ ID NO: 22022 - RNA, 24 nt, synthetic construct
  misc_feature 1..24: note = derived and/or modified sequence opt2 from anti-influenza_CDR
  source 1..24: mol_type = other RNA
ggcgtcacctcctccaactacccc

SEQ ID NO: 22023 - RNA, 24 nt, synthetic construct
  misc_feature 1..24: note = derived and/or modified sequence opt2 from anti-influenza_CDR
  source 1..24: mol_type = other RNA
atcatcgccatcttcggcaccacc

SEQ ID NO: 22024 - RNA, 24 nt, synthetic construct
  misc_feature 1..24: note = derived and/or modified sequence opt2 from anti-influenza_CDR
  source 1..24: mol_type = other RNA
atcatccccctcttcggcaccgcc

SEQ ID NO: 22025 - RNA, 24 nt, synthetic construct
  misc_feature 1..24: note = derived and/or modified sequence opt2 from anti-influenza_CDR
  source 1..24: mol_type = other RNA
atcatccccctcttcggcaccacc

SEQ ID NO: 22026 - RNA, 24 nt, synthetic construct
  misc_feature 1..24: note = derived and/or modified sequence opt2 from anti-influenza_CDR
  source 1..24: mol_type = other RNA
atcatccccatgttcggcgccacc

SEQ ID NO: 22027 - RNA, 24 nt, synthetic construct
  misc_feature 1..24: note = derived and/or modified sequence opt2 from anti-influenza_CDR
  source 1..24: mol_type = other RNA
atcatccccatgttcggcaccacc

SEQ ID NO: 22028 - RNA, 24 nt, synthetic construct
  misc_feature 1..24: note = derived and/or modified sequence opt2 from anti-influenza_CDR
  source 1..24: mol_type = other RNA
atcaactccggcggcggcgccacc

SEQ ID NO: 22029 - RNA, 24 nt, synthetic construct
  misc_feature 1..24: note = derived and/or modified sequence opt2 from anti-influenza_CDR
  source 1..24: mol_type = other RNA
atctccgccgtcttcggcaccgcc

SEQ ID NO: 22030 - RNA, 24 nt, synthetic construct
  misc_feature 1..24: note = derived and/or modified sequence opt2 from anti-influenza_CDR
  source 1..24: mol_type = other RNA
atctcctacgacgccaactacaag

SEQ ID NO: 22031 - RNA, 24 nt, synthetic construct
  misc_feature 1..24: note = derived and/or modified sequence opt2 from anti-influenza_CDR
  source 1..24: mol_type = other RNA
atctcctacgacggcaactacaag

SEQ ID NO: 22032 - RNA, 24 nt, synthetic construct
  misc_feature 1..24: note = derived and/or modified sequence opt2 from anti-influenza_CDR
  source 1..24: mol_type = other RNA
atctcctacgacggctccaacaag

SEQ ID NO: 22033 - RNA, 24 nt, synthetic construct
  misc_feature 1..24: note = derived and/or modified sequence opt2 from anti-influenza_CDR
  source 1..24: mol_type = other RNA
atctcctacgacggctccaaccag

SEQ ID NO: 22034 - RNA, 24 nt, synthetic construct
  misc_feature 1..24: note = derived and/or modified sequence opt2 from anti-influenza_CDR
  source 1..24: mol_type = other RNA
cagcagtactaccgctccccctcc

SEQ ID NO: 22035 - RNA, 24 nt, synthetic construct
  misc_feature 1..24: note = derived and/or modified sequence opt2 from anti-influenza_CDR
  source 1..24: mol_type = other RNA
gtcctccccctcttcggcgtcacc

SEQ ID NO: 22036 - RNA, 24 nt, synthetic construct
  misc_feature 1..24: note = derived and/or modified sequence opt2 from anti-influenza_CDR
  source 1..24: mol_type = other RNA
ggcggcaccttctcctccgacgcc

SEQ ID NO: 22037 - RNA, 24 nt, synthetic construct
  misc_feature 1..24: note = derived and/or modified sequence opt2 from anti-influenza_CDR
  source 1..24: mol_type = other RNA
atcatccccgtcttccagaccgcc

SEQ ID NO: 22038 - RNA, 24 nt, synthetic construct
  misc_feature 1..24: note = derived and/or modified sequence opt2 from anti-influenza_CDR
  source 1..24: mol_type = other RNA
acctccaacatcggctccaacgcc

SEQ ID NO: 22039 - RNA, 24 nt, synthetic construct
  misc_feature 1..24: note = derived and/or modified sequence opt2 from anti-influenza_CDR
  source 1..24: mol_type = other RNA
ggctactccttcacctcccgctgg

SEQ ID NO: 22040 - RNA, 24 nt, synthetic construct
  misc_feature 1..24: note = derived and/or modified sequence opt2 from anti-influenza_CDR
  source 1..24: mol_type = other RNA
atctacccctccgactccgacgtc

SEQ ID NO: 22041 - RNA, 24 nt, synthetic construct
  misc_feature 1..24: note = derived and/or modified sequence opt2 from anti-influenza_CDR
  source 1..24: mol_type = other RNA
cagcagtacgacaactggctctcc

SEQ ID NO: 22042 - RNA, 24 nt, synthetic construct
  misc_feature 1..24: note = derived and/or modified sequence opt2 from anti-influenza_CDR
  source 1..24: mol_type = other RNA
ggcggcaccttctccaactacggc

SEQ ID NO: 22043 - RNA, 24 nt, synthetic construct
  misc_feature 1..24: note = derived and/or modified sequence opt2 from anti-influenza_CDR
  source 1..24: mol_type = other RNA
ggcgcctccatctcctcctcctac

SEQ ID NO: 22044 - RNA, 24 nt, synthetic construct
  misc_feature 1..24: note = derived and/or modified sequence opt2 from anti-influenza_CDR
  source 1..24: mol_type = other RNA
ggcggcaccttctcctcctacgac

SEQ ID NO: 22045 - RNA, 24 nt, synthetic construct
  misc_feature 1..24: note = derived and/or modified sequence opt2 from anti-influenza_CDR
  source 1..24: mol_type = other RNA
atcatccccatctacggcaccgcc

SEQ ID NO: 22046 - RNA, 24 nt, synthetic construct
  misc_feature 1..24: note = derived and/or modified sequence opt2 from anti-influenza_CDR
  source 1..24: mol_type = other RNA
ggctacacctccaccacctacggc

SEQ ID NO: 22047 - RNA, 24 nt, synthetic construct
  misc_feature 1..24: note = derived and/or modified sequence opt2 from anti-influenza_CDR
  source 1..24: mol_type = other RNA
atcaacccctacaacggcaacccc

SEQ ID NO: 22048 - RNA, 24 nt, synthetic construct
  misc_feature 1..24: note = derived and/or modified sequence opt2 from anti-influenza_CDR
  source 1..24: mol_type = other RNA
atctggtacgacggcgacaacaag

SEQ ID NO: 22049 - RNA, 24 nt, synthetic construct
  misc_feature 1..24: note = derived and/or modified sequence opt2 from anti-influenza_CDR
  source 1..24: mol_type = other RNA
ggcttcaccttctccgacttctgg

SEQ ID NO: 22050 - RNA, 24 nt, synthetic construct
  misc_feature 1..24: note = derived and/or modified sequence opt2 from anti-influenza_CDR
  source 1..24: mol_type = other RNA
atcgaccaggacggcaacgagcgc

SEQ ID NO: 22051 - RNA, 24 nt, synthetic construct
  misc_feature 1..24: note = derived and/or modified sequence opt2 from anti-influenza_CDR
  source 1..24: mol_type = other RNA
tcctccaacatcggcaagaactac

SEQ ID NO: 22052 - RNA, 24 nt, synthetic construct
  misc_feature 1..24: note = derived and/or modified sequence opt2 from anti-influenza_CDR
  source 1..24: mol_type = other RNA
ggctacaccttcaccaactactgg

SEQ ID NO: 22053 - RNA, 24 nt, synthetic construct
  misc_feature 1..24: note = derived and/or modified sequence opt2 from anti-influenza_CDR
  source 1..24: mol_type = other RNA
atcttcccccccgactcccagacc

SEQ ID NO: 22054 - RNA, 24 nt, synthetic construct
  misc_feature 1..24: note = derived and/or modified sequence opt2 from anti-influenza_CDR
  source 1..24: mol_type = other RNA
ggctactccttctccgactactgg

SEQ ID NO: 22055 - RNA, 24 nt, synthetic construct
  misc_feature 1..24: note = derived and/or modified sequence opt2 from anti-influenza_CDR
  source 1..24: mol_type = other RNA
atctaccccgcctcctccgagatc

SEQ ID NO: 22056 - RNA, 24 nt, synthetic construct
  misc_feature 1..24: note = derived and/or modified sequence opt2 from anti-influenza_CDR
  source 1..24: mol_type = other RNA
tccggcgactccggcacctggaac

SEQ ID NO: 22057 - RNA, 24 nt, synthetic construct
  misc_feature 1..24: note = derived and/or modified sequence opt2 from anti-influenza_CDR
  source 1..24: mol_type = other RNA
ggcggcaccctcaacaactacgcc

SEQ ID NO: 22058 - RNA, 24 nt, synthetic construct
  misc_feature 1..24: note = derived and/or modified sequence opt2 from anti-influenza_CDR
  source 1..24: mol_type = other RNA
atctcccccatcttcggcaccctc

SEQ ID NO: 22059 - RNA, 24 nt, synthetic construct
  misc_feature 1..24: note = derived and/or modified sequence opt2 from anti-influenza_CDR
  source 1..24: mol_type = other RNA
ggcgtcttcttctcctcccacgcc

SEQ ID NO: 22060 - RNA, 24 nt, synthetic construct
  misc_feature 1..24: note = derived and/or modified sequence opt2 from anti-influenza_CDR
  source 1..24: mol_type = other RNA
atctcccccatgttcggcaccacc

SEQ ID NO: 22061 - RNA, 24 nt, synthetic construct
  misc_feature 1..24: note = derived and/or modified sequence opt2 from anti-influenza_CDR
  source 1..24: mol_type = other RNA
ggcttcaccttctcccgcttcggc

SEQ ID NO: 22062 - RNA, 24 nt, synthetic construct
  misc_feature 1..24: note = derived and/or modified sequence opt2 from anti-influenza_CDR
  source 1..24: mol_type = other RNA
atctggtacgacggctccaacaag

SEQ ID NO: 22063 - RNA, 24 nt, synthetic construct
  misc_feature 1..24: note = derived and/or modified sequence opt2 from anti-influenza_CDR
  source 1..24: mol_type = other RNA
cagacctacggcggcgtctccacc

SEQ ID NO: 22064 - RNA, 24 nt, synthetic construct
  misc_feature 1..24: note = derived and/or modified sequence opt2 from anti-influenza_CDR
  source 1..24: mol_type = other RNA
gactccgccggcaaccgccactcc

SEQ ID NO: 22065 - RNA, 24 nt, synthetic construct
  misc_feature 1..24: note = derived and/or modified sequence opt2 from anti-influenza_CDR
  source 1..24: mol_type = other RNA
ttccgcggcggcaactccctctcc

SEQ ID NO: 22066 - RNA, 24 nt, synthetic construct
  misc_feature 1..24: note = derived and/or modified sequence opt2 from anti-influenza_CDR
  source 1..24: mol_type = other RNA
ggctacaccttcaccacctactgg

SEQ ID NO: 22067 - RNA, 24 nt, synthetic construct
  misc_feature 1..24: note = derived and/or modified sequence opt2 from anti-influenza_CDR
  source 1..24: mol_type = other RNA
atcgacccctacgactccgagacc

SEQ ID NO: 22068 - RNA, 24 nt, synthetic construct
  misc_feature 1..24: note = derived and/or modified sequence opt2 from anti-influenza_CDR
  source 1..24: mol_type = other RNA
atccgcaagttcctcaactggtac

SEQ ID NO: 22069 - RNA, 24 nt, synthetic construct
  misc_feature 1..24: note = derived and/or modified sequence opt2 from anti-influenza_CDR
  source 1..24: mol_type = other RNA
cagcagtacgacggcctccccttc

SEQ ID NO: 22070 - RNA, 24 nt, synthetic construct
  misc_feature 1..24: note = derived and/or modified sequence opt2 from anti-influenza_CDR
  source 1..24: mol_type = other RNA
atccgcaactccctcaactggtac

SEQ ID NO: 22071 - RNA, 24 nt, synthetic construct
  misc_feature 1..24: note = derived and/or modified sequence opt2 from anti-influenza_CDR
  source 1..24: mol_type = other RNA
cagcaggccaactccttccccctc

SEQ ID NO: 22072 - RNA, 24 nt, synthetic construct
  misc_feature 1..24: note = derived and/or modified sequence opt2 from anti-influenza_CDR
  source 1..24: mol_type = other RNA
tccctcctcaccgaggtcgagacc

SEQ ID NO: 22073 - RNA, 24 nt, synthetic construct
  misc_feature 1..24: note = derived and/or modified sequence opt2 from anti-influenza_CDR
  source 1..24: mol_type = other RNA
cagcagtcctactccatgcccgcc

SEQ ID NO: 22074 - RNA, 24 nt, synthetic construct
  misc_feature 1..24: note = derived and/or modified sequence opt2 from anti-influenza_CDR
  source 1..24: mol_type = other RNA
ggcggccccgtctccggcggcggc

SEQ ID NO: 22075 - RNA, 24 nt, synthetic construct
  misc_feature 1..24: note = derived and/or modified sequence opt2 from anti-influenza_CDR
  source 1..24: mol_type = other RNA
cagcagtccttctccgtccccgcc

SEQ ID NO: 22076 - RNA, 24 nt, synthetic construct
  misc_feature 1..24: note = derived and/or modified sequence opt2 from anti-influenza_CDR
  source 1..24: mol_type = other RNA
cagcagacctactccatccccctc

SEQ ID NO: 22077 - RNA, 24 nt, synthetic construct
  misc_feature 1..24: note = derived and/or modified sequence opt2 from anti-influenza_CDR
  source 1..24: mol_type = other RNA
cagcagtcctactccgtccccgcc

SEQ ID NO: 22078 - RNA, 24 nt, synthetic construct
  misc_feature 1..24: note = derived and/or modified sequence opt2 from anti-influenza_CDR
  source 1..24: mol_type = other RNA
cagcagaccttctccatccccctc

SEQ ID NO: 22079 - RNA, 24 nt, synthetic construct
  misc_feature 1..24: note = derived and/or modified sequence opt2 from anti-influenza_CDR
  source 1..24: mol_type = other RNA
ggcgactccatcacctccggcgcc

SEQ ID NO: 22080 - RNA, 24 nt, synthetic construct
  misc_feature 1..24: note = derived and/or modified sequence opt2 from anti-influenza_CDR
  source 1..24: mol_type = other RNA
caggcctgggactcctccaccgcc

SEQ ID NO: 22081 - RNA, 24 nt, synthetic construct
  misc_feature 1..24: note = derived and/or modified sequence opt2 from anti-influenza_CDR
  source 1..24: mol_type = other RNA
cagcagtacggctcctccctctgg

SEQ ID NO: 22082 - RNA, 24 nt, synthetic construct
  misc_feature 1..24: note = derived and/or modified sequence opt2 from anti-influenza_CDR
  source 1..24: mol_type = other RNA
gcctacggctacaccttcgacccc

SEQ ID NO: 22083 - RNA, 24 nt, synthetic construct
  misc_feature 1..24: note = derived and/or modified sequence opt2 from anti-influenza_CDR
  source 1..24: mol_type = other RNA
atgcaggccctccagacccccctc

SEQ ID NO: 22084 - RNA, 24 nt, synthetic construct
  misc_feature 1..24: note = derived and/or modified sequence opt2 from anti-influenza_CDR
  source 1..24: mol_type = other RNA
cagcagtacggctcctccctcacc

SEQ ID NO: 22085 - RNA, 24 nt, synthetic construct
  misc_feature 1..24: note = derived and/or modified sequence opt2 from anti-influenza_CDR
  source 1..24: mol_type = other RNA
cagaagtacaactccgccccctcc

SEQ ID NO: 22086 - RNA, 24 nt, synthetic construct
  misc_feature 1..24: note = derived and/or modified sequence opt2 from anti-influenza_CDR
  source 1..24: mol_type = other RNA
cagcagcgctccaactggctcaag

SEQ ID NO: 22087 - RNA, 24 nt, synthetic construct
  misc_feature 1..24: note = derived and/or modified sequence opt2 from anti-influenza_CDR
  source 1..24: mol_type = other RNA
tcctcccagtcccgctcctccacc

SEQ ID NO: 22088 - RNA, 24 nt, synthetic construct
  misc_feature 1..24: note = derived and/or modified sequence opt2 from anti-influenza_CDR
  source 1..24: mol_type = other RNA
ccctacgacgtccccgactacgag

SEQ ID NO: 22089 - RNA, 24 nt, synthetic construct
  misc_feature 1..24: note = derived and/or modified sequence opt2 from anti-influenza_CDR
  source 1..24: mol_type = other RNA
ccctacgacgtccccgactacgcc

SEQ ID NO: 22090 - RNA, 24 nt, synthetic construct
  misc_feature 1..24: note = derived and/or modified sequence opt2 from anti-influenza_CDR
  source 1..24: mol_type = other RNA
cccggcgacttcaacgactacgag

SEQ ID NO: 22091 - RNA, 24 nt, synthetic construct
  misc_feature 1..24: note = derived and/or modified sequence opt2 from anti-influenza_CDR
  source 1..24: mol_type = other RNA
cccaaggtccgcgaccaggagtcc

SEQ ID NO: 22092 - RNA, 24 nt, synthetic construct
  misc_feature 1..24: note = derived and/or modified sequence opt2 from anti-influenza_CDR
  source 1..24: mol_type = other RNA
acctcctacacctcctccaacacc

SEQ ID NO: 22093 - RNA, 24 nt, synthetic construct
  misc_feature 1..24: note = derived and/or modified sequence opt2 from anti-influenza_CDR
  source 1..24: mol_type = other RNA
ggcggcaacttcaacaactacgcc

SEQ ID NO: 22094 - RNA, 24 nt, synthetic construct
  misc_feature 1..24: note = derived and/or modified sequence opt2 from anti-influenza_CDR
  source 1..24: mol_type = other RNA
atctcccccatcttcggctccacc

SEQ ID NO: 22095 - RNA, 24 nt, synthetic construct
  misc_feature 1..24: note = derived and/or modified sequence opt2 from anti-influenza_CDR
  source 1..24: mol_type = other RNA
tcctcctacacctcctccaacacc

SEQ ID NO: 22096 - RNA, 24 nt, synthetic construct
  misc_feature 1..24: note = derived and/or modified sequence opt2 from anti-influenza_CDR
  source 1..24: mol_type = other RNA
ggcggcaccttcaacaactacgcc

SEQ ID NO: 22097 - RNA, 24 nt, synthetic construct
  misc_feature 1..24: note = derived and/or modified sequence opt2 from anti-influenza_CDR
  source 1..24: mol_type = other RNA
atctcccccatcttcggctccgtc

SEQ ID NO: 22098 - RNA, 24 nt, synthetic construct
  misc_feature 1..24: note = derived and/or modified sequence opt2 from anti-influenza_CDR
  source 1..24: mol_type = other RNA
tcctccaacatcggccacaacttc

SEQ ID NO: 22099 - RNA, 24 nt, synthetic construct
  misc_feature 1..24: note = derived and/or modified sequence opt2 from anti-influenza_CDR
  source 1..24: mol_type = other RNA
ggcacctgggactcctccctctcc

SEQ ID NO: 22100 - RNA, 24 nt, synthetic construct
  misc_feature 1..24: note = derived and/or modified sequence opt2 from anti-influenza_CDR
  source 1..24: mol_type = other RNA
ggcggcatcatccgcaagtacgcc

SEQ ID NO: 22101 - RNA, 24 nt, synthetic construct
  misc_feature 1..24: note = derived and/or modified sequence opt2 from anti-influenza_CDR
  source 1..24: mol_type = other RNA
atcatcgccatcttcaacaccgcc

SEQ ID NO: 22102 - RNA, 24 nt, synthetic construct
  misc_feature 1..24: note = derived and/or modified sequence opt2 from anti-influenza_CDR
  source 1..24: mol_type = other RNA
ggctacaccttcaccgcctacacc

SEQ ID NO: 22103 - RNA, 24 nt, synthetic construct
  misc_feature 1..24: note = derived and/or modified sequence opt2 from anti-influenza_CDR
  source 1..24: mol_type = other RNA
atcaacgccggcaacggccacacc

SEQ ID NO: 22104 - RNA, 24 nt, synthetic construct
  misc_feature 1..24: note = derived and/or modified sequence opt2 from anti-influenza_CDR
  source 1..24: mol_type = other RNA
ggcggcaccttcatcaactacgcc

SEQ ID NO: 22105 - RNA, 24 nt, synthetic construct
  misc_feature 1..24: note = derived and/or modified sequence opt2 from anti-influenza_CDR
  source 1..24: mol_type = other RNA
atcatccccgtctacggcacctcc

SEQ ID NO: 22106 - RNA, 24 nt, synthetic construct
  misc_feature 1..24: note = derived and/or modified sequence opt2 from anti-influenza_CDR
  source 1..24: mol_type = other RNA
ggcttcaccttccgctcccacgcc

SEQ ID NO: 22107 - RNA, 24 nt, synthetic construct
  misc_feature 1..24: note = derived and/or modified sequence opt2 from anti-influenza_CDR
  source 1..24: mol_type = other RNA
atctcctacgacgaggtcaacaag

SEQ ID NO: 22108 - RNA, 24 nt, synthetic construct
  misc_feature 1..24: note = derived and/or modified sequence opt2 from anti-influenza_CDR
  source 1..24: mol_type = other RNA
ggctacaacttcgccgcctactac

SEQ ID NO: 22109 - RNA, 24 nt, synthetic construct
  misc_feature 1..24: note = derived and/or modified sequence opt2 from anti-influenza_CDR
  source 1..24: mol_type = other RNA
tccaaccccaacaccggcggcgcc

SEQ ID NO: 22110 - RNA, 24 nt, synthetic construct
  misc_feature 1..24: note = derived and/or modified sequence opt2 from anti-influenza_CDR
  source 1..24: mol_type = other RNA
ggctacaccctcatcgactactac

SEQ ID NO: 22111 - RNA, 24 nt, synthetic construct
  misc_feature 1..24: note = derived and/or modified sequence opt2 from anti-influenza_CDR
  source 1..24: mol_type = other RNA
atcaaccccatcaacggcggcacc

SEQ ID NO: 22112 - RNA, 24 nt, synthetic construct
  misc_feature 1..24: note = derived and/or modified sequence opt2 from anti-influenza_CDR
  source 1..24: mol_type = other RNA
ggcttcaccttctccgcctacgcc

SEQ ID NO: 22113 - RNA, 24 nt, synthetic construct
  misc_feature 1..24: note = derived and/or modified sequence opt2 from anti-influenza_CDR
  source 1..24: mol_type = other RNA
acctcctacgacggccgcgactcc

SEQ ID NO: 22114 - RNA, 24 nt, synthetic construct
  misc_feature 1..24: note = derived and/or modified sequence opt2 from anti-influenza_CDR
  source 1..24: mol_type = other RNA
ggcttcaccttcaccaactacgcc

SEQ ID NO: 22115 - RNA, 24 nt, synthetic construct
  misc_feature 1..24: note = derived and/or modified sequence opt2 from anti-influenza_CDR
  source 1..24: mol_type = other RNA
atctccttcgacgaggacaacaag

SEQ ID NO: 22116 - RNA, 24 nt, synthetic construct
  misc_feature 1..24: note = derived and/or modified sequence opt2 from anti-influenza_CDR
  source 1..24: mol_type = other RNA
ggcttcaacttctcctcctacggc

SEQ ID NO: 22117 - RNA, 24 nt, synthetic construct
  misc_feature 1..24: note = derived and/or modified sequence opt2 from anti-influenza_CDR
  source 1..24: mol_type = other RNA
atctggtccggcggctccaacaag

SEQ ID NO: 22118 - RNA, 24 nt, synthetic construct
  misc_feature 1..24: note = derived and/or modified sequence opt2 from anti-influenza_CDR
  source 1..24: mol_type = other RNA
ggcttcatcttcggcgacttcgcc

SEQ ID NO: 22119 - RNA, 24 nt, synthetic construct
  misc_feature 1..24: note = derived and/or modified sequence opt2 from anti-influenza_CDR
  source 1..24: mol_type = other RNA
ggcttcaacttcgacgagtacgtc

SEQ ID NO: 22120 - RNA, 24 nt, synthetic construct
  misc_feature 1..24: note = derived and/or modified sequence opt2 from anti-influenza_CDR
  source 1..24: mol_type = other RNA
atcggcgccgacggccgcggcacc

SEQ ID NO: 22121 - RNA, 24 nt, synthetic construct
  misc_feature 1..24: note = derived and/or modified sequence opt2 from anti-influenza_CDR
  source 1..24: mol_type = other RNA
ggcggctccgtctccaactactac

SEQ ID NO: 22122 - RNA, 24 nt, synthetic construct
  misc_feature 1..24: note = derived and/or modified sequence opt2 from anti-influenza_CDR
  source 1..24: mol_type = other RNA
ggcggcaccttctcctactacgcc

SEQ ID NO: 22123 - RNA, 24 nt, synthetic construct
  misc_feature 1..24: note = derived and/or modified sequence opt2 from anti-influenza_CDR
  source 1..24: mol_type = other RNA
atcatccccatcgtcggcaccgcc

SEQ ID NO: 22124 - RNA, 24 nt, synthetic construct
  misc_feature 1..24: note = derived and/or modified sequence opt2 from anti-influenza_CDR
  source 1..24: mol_type = other RNA
acctccaacatcggctccaacacc

SEQ ID NO: 22125 - RNA, 24 nt, synthetic construct
  misc_feature 1..24: note = derived and/or modified sequence opt2 from anti-influenza_CDR
  source 1..24: mol_type = other RNA
ggctacaacttccccaagtactgg

SEQ ID NO: 22126 - RNA, 24 nt, synthetic construct
  misc_feature 1..24: note = derived and/or modified sequence opt2 from anti-influenza_CDR
  source 1..24: mol_type = other RNA
atctaccccggcgactccgacgtc

SEQ ID NO: 22127 - RNA, 24 nt, synthetic construct
  misc_feature 1..24: note = derived and/or modified sequence opt2 from anti-influenza_CDR
  source 1..24: mol_type = other RNA
ggccacaccttcatctcctacgcc

SEQ ID NO: 22128 - RNA, 24 nt, synthetic construct
  misc_feature 1..24: note = derived and/or modified sequence opt2 from anti-influenza_CDR
  source 1..24: mol_type = other RNA
atcgtccccatcttcggcaccgtc

SEQ ID NO: 22129 - RNA, 24 nt, synthetic construct
  misc_feature 1..24: note = derived and/or modified sequence opt2 from anti-influenza_CDR
  source 1..24: mol_type = other RNA
ggcttcaccttccgcacctacggc

SEQ ID NO: 22130 - RNA, 24 nt, synthetic construct
  misc_feature 1..24: note = derived and/or modified sequence opt2 from anti-influenza_CDR
  source 1..24: mol_type = other RNA
atctcctacgacggcaccaacaag

SEQ ID NO: 22131 - RNA, 24 nt, synthetic construct
  misc_feature 1..24: note = derived and/or modified sequence opt2 from anti-influenza_CDR
  source 1..24: mol_type = other RNA
ggcttcaccttctcctcctacggc

SEQ ID NO: 22132 - RNA, 24 nt, synthetic construct
  misc_feature 1..24: note = derived and/or modified sequence opt2 from anti-influenza_CDR
  source 1..24: mol_type = other RNA
atctcctacgacgagatcaacaag

SEQ ID NO: 22133 - RNA, 24 nt, synthetic construct
  misc_feature 1..24: note = derived and/or modified sequence opt2 from anti-influenza_CDR
  source 1..24: mol_type = other RNA
ggcttctccctctggacctccggc

SEQ ID NO: 22134 - RNA, 24 nt, synthetic construct
  misc_feature 1..24: note = derived and/or modified sequence opt2 from anti-influenza_CDR
  source 1..24: mol_type = other RNA
atgtcctacgacgagaccaagaag

SEQ ID NO: 22135 - RNA, 24 nt, synthetic construct
  misc_feature 1..24: note = derived and/or modified sequence opt2 from anti-influenza_CDR
  source 1..24: mol_type = other RNA
ggcttcaccttctcccgctactcc

SEQ ID NO: 22136 - RNA, 24 nt, synthetic construct
  misc_feature 1..24: note = derived and/or modified sequence opt2 from anti-influenza_CDR
  source 1..24: mol_type = other RNA
atctccgacacctcccgcaccatc

SEQ ID NO: 22137 - RNA, 24 nt, synthetic construct
  misc_feature 1..24: note = derived and/or modified sequence opt2 from anti-influenza_CDR
  source 1..24: mol_type = other RNA
ggcttcaccttcaactcctacgcc

SEQ ID NO: 22138 - RNA, 24 nt, synthetic construct
  misc_feature 1..24: note = derived and/or modified sequence opt2 from anti-influenza_CDR
  source 1..24: mol_type = other RNA
atccgcggctccggcgagaacacc

SEQ ID NO: 22139 - RNA, 24 nt, synthetic construct
  misc_feature 1..24: note = derived and/or modified sequence opt2 from anti-influenza_CDR
  source 1..24: mol_type = other RNA
ggcttcaccttctcccgcttctcc

SEQ ID NO: 22140 - RNA, 24 nt, synthetic construct
  misc_feature 1..24: note = derived and/or modified sequence opt2 from anti-influenza_CDR
  source 1..24: mol_type = other RNA
atctccgacaccggccgcaccatc

SEQ ID NO: 22141 - RNA, 24 nt, synthetic construct
  misc_feature 1..24: note = derived and/or modified sequence opt2 from anti-influenza_CDR
  source 1..24: mol_type = other RNA
ggcgactccttcacctcctactgg

SEQ ID NO: 22142 - RNA, 24 nt, synthetic construct
  misc_feature 1..24: note = derived and/or modified sequence opt2 from anti-influenza_CDR
  source 1..24: mol_type = other RNA
atctacccccgcgactccgagacc

SEQ ID NO: 22143 - RNA, 24 nt, synthetic construct
  misc_feature 1..24: note = derived and/or modified sequence opt2 from anti-influenza_CDR
  source 1..24: mol_type = other RNA
ggctacaccttcaccgcctaccac

SEQ ID NO: 22144 - RNA, 24 nt, synthetic construct
  misc_feature 1..24: note = derived and/or modified sequence opt2 from anti-influenza_CDR
  source 1..24: mol_type = other RNA
atcaaccccaactccggcgccacc

SEQ ID NO: 22145 - RNA, 24 nt, synthetic construct
  misc_feature 1..24: note = derived and/or modified sequence opt2 from anti-influenza_CDR
  source 1..24: mol_type = other RNA
ggcttcaccttctccgactactgg

SEQ ID NO: 22146 - RNA, 24 nt, synthetic construct
  misc_feature 1..24: note = derived and/or modified sequence opt2 from anti-influenza_CDR
  source 1..24: mol_type = other RNA
atctcctccgacggctccaccacc

SEQ ID NO: 22147 - RNA, 24 nt, synthetic construct
  misc_feature 1..24: note = derived and/or modified sequence opt2 from anti-influenza_CDR
  source 1..24: mol_type = other RNA
ggcttctccttctccaacgcctgg

SEQ ID NO: 22148 - RNA, 24 nt, synthetic construct
  misc_feature 1..24: note = derived and/or modified sequence opt2 from anti-influenza_CDR
  source 1..24: mol_type = other RNA
ggcctcaccttctccaacgcctgg

SEQ ID NO: 22149 - RNA, 24 nt, synthetic construct
  misc_feature 1..24: note = derived and/or modified sequence opt2 from anti-influenza_CDR
  source 1..24: mol_type = other RNA
ggcttcaccttctccaacgcctgg

SEQ ID NO: 22150 - RNA, 24 nt, synthetic construct
  misc_feature 1..24: note = derived and/or modified sequence opt2 from anti-influenza_CDR
  source 1..24: mol_type = other RNA
ggcctctccttcctcaacgcctgg

SEQ ID NO: 22151 - RNA, 24 nt, synthetic construct
  misc_feature 1..24: note = derived and/or modified sequence opt2 from anti-influenza_CDR
  source 1..24: mol_type = other RNA
ggcttctccttcctcaacgcctgg

SEQ ID NO: 22152 - RNA, 24 nt, synthetic construct
  misc_feature 1..24: note = derived and/or modified sequence opt2 from anti-influenza_CDR
  source 1..24: mol_type = other RNA
ggcctcaccttcctcaacgcctgg

SEQ ID NO: 22153 - RNA, 24 nt, synthetic construct
  misc_feature 1..24: note = derived and/or modified sequence opt2 from anti-influenza_CDR
  source 1..24: mol_type = other RNA
ggcttcaccttcctcaacgcctgg

SEQ ID NO: 22154 - RNA, 24 nt, synthetic construct
  misc_feature 1..24: note = derived and/or modified sequence opt2 from anti-influenza_CDR
  source 1..24: mol_type = other RNA
ggctacaccttcaccgactactac

SEQ ID NO: 22155 - RNA, 24 nt, synthetic construct
  misc_feature 1..24: note = derived and/or modified sequence opt2 from anti-influenza_CDR
  source 1..24: mol_type = other RNA
gtcaacccctactccggcggcacc

SEQ ID NO: 22156 - RNA, 24 nt, synthetic construct
  misc_feature 1..24: note = derived and/or modified sequence opt2 from anti-influenza_CDR
  source 1..24: mol_type = other RNA
ggctacaccttcaccgactacaac

SEQ ID NO: 22157 - RNA, 24 nt, synthetic construct
  misc_feature 1..24: note = derived and/or modified sequence opt2 from anti-influenza_CDR
  source 1..24: mol_type = other RNA
atctaccccaacaacggcggcacc

SEQ ID NO: 22158 - RNA, 24 nt, synthetic construct
  misc_feature 1..24: note = derived and/or modified sequence opt2 from anti-influenza_CDR
  source 1..24: mol_type = other RNA
ggctacaccttcaccggctacaac

SEQ ID NO: 22159 - RNA, 24 nt, synthetic construct
  misc_feature 1..24: note = derived and/or modified sequence opt2 from anti-influenza_CDR
  source 1..24: mol_type = other RNA
atctaccccaacaacggcgtcacc

SEQ ID NO: 22160 - RNA, 24 nt, synthetic construct
  misc_feature 1..24: note = derived and/or modified sequence opt2 from anti-influenza_CDR
  source 1..24: mol_type = other RNA
atggagaccgacaccctcctcctc

SEQ ID NO: 22161 - RNA, 27 nt, synthetic construct
  misc_feature 1..27: note = derived and/or modified sequence opt2 from anti-influenza_CDR
  source 1..27: mol_type = other RNA
gacggcgtcaccaacaaggtcaactcc

SEQ ID NO: 22162 - RNA, 27 nt, synthetic construct
  misc_feature 1..27: note = derived and/or modified sequence opt2 from anti-influenza_CDR
  source 1..27: mol_type = other RNA
ggctccgacgtcggctcctccaacctc

SEQ ID NO: 22163 - RNA, 27 nt, synthetic construct
  misc_feature 1..27: note = derived and/or modified sequence opt2 from anti-influenza_CDR
  source 1..27: mol_type = other RNA
atgcagaacatcctcctccccctcacc

SEQ ID NO: 22164 - RNA, 27 nt, synthetic construct
  misc_feature 1..27: note = derived and/or modified sequence opt2 from anti-influenza_CDR
  source 1..27: mol_type = other RNA
atgcagtccctccagctccccctcacc

SEQ ID NO: 22165 - RNA, 27 nt, synthetic construct
  misc_feature 1..27: note = derived and/or modified sequence opt2 from anti-influenza_CDR
  source 1..27: mol_type = other RNA
cagcagcactaccgcaccccccccacc

SEQ ID NO: 22166 - RNA, 27 nt, synthetic construct
  misc_feature 1..27: note = derived and/or modified sequence opt2 from anti-influenza_CDR
  source 1..27: mol_type = other RNA
cagcagtacggcaactccccctacacc

SEQ ID NO: 22167 - RNA, 27 nt, synthetic construct
  misc_feature 1..27: note = derived and/or modified sequence opt2 from anti-influenza_CDR
  source 1..27: mol_type = other RNA
cagcagtacggctcctccccctacacc

SEQ ID NO: 22168 - RNA, 27 nt, synthetic construct
  misc_feature 1..27: note = derived and/or modified sequence opt2 from anti-influenza_CDR
  source 1..27: mol_type = other RNA
cagcagtacggcacctccccccagacc

SEQ ID NO: 22169 - RNA, 27 nt, synthetic construct
  misc_feature 1..27: note = derived and/or modified sequence opt2 from anti-influenza_CDR
  source 1..27: mol_type = other RNA
cagcagtacggctacctccccctcacc

SEQ ID NO: 22170 - RNA, 27 nt, synthetic construct
  misc_feature 1..27: note = derived and/or modified sequence opt2 from anti-influenza_CDR
  source 1..27: mol_type = other RNA
caggcctgggactcctccaccgccgtc

SEQ ID NO: 22171 - RNA, 27 nt, synthetic construct
  misc_feature 1..27: note = derived and/or modified sequence opt2 from anti-influenza_CDR
  source 1..27: mol_type = other RNA
cagcactacaacgcctactggggcacc

SEQ ID NO: 22172 - RNA, 27 nt, synthetic construct
  misc_feature 1..27: note = derived and/or modified sequence opt2 from anti-influenza_CDR
  source 1..27: mol_type = other RNA
cagcagacctactcctccccccccacc

SEQ ID NO: 22173 - RNA, 27 nt, synthetic construct
  misc_feature 1..27: note = derived and/or modified sequence opt2 from anti-influenza_CDR
  source 1..27: mol_type = other RNA
cagcagtactactccttcccctacacc

SEQ ID NO: 22174 - RNA, 27 nt, synthetic construct
  misc_feature 1..27: note = derived and/or modified sequence opt2 from anti-influenza_CDR
  source 1..27: mol_type = other RNA
atgcaggccctccagctccccctcgcc

SEQ ID NO: 22175 - RNA, 27 nt, synthetic construct
  misc_feature 1..27: note = derived and/or modified sequence opt2 from anti-influenza_CDR
  source 1..27: mol_type = other RNA
cagcaggccaactccttccccttcacc

SEQ ID NO: 22176 - RNA, 27 nt, synthetic construct
  misc_feature 1..27: note = derived and/or modified sequence opt2 from anti-influenza_CDR
  source 1..27: mol_type = other RNA
cagcagctcaacggctaccccctcacc

SEQ ID NO: 22177 - RNA, 27 nt, synthetic construct
  misc_feature 1..27: note = derived and/or modified sequence opt2 from anti-influenza_CDR
  source 1..27: mol_type = other RNA
atgcaggccctccagacccccctcacc

SEQ ID NO: 22178 - RNA, 27 nt, synthetic construct
  misc_feature 1..27: note = derived and/or modified sequence opt2 from anti-influenza_CDR
  source 1..27: mol_type = other RNA
cagcagaactacaactggcccctcacc

SEQ ID NO: 22179 - RNA, 27 nt, synthetic construct
  misc_feature 1..27: note = derived and/or modified sequence opt2 from anti-influenza_CDR
  source 1..27: mol_type = other RNA
cagcagtacgacacctcctccggcctc

SEQ ID NO: 22180 - RNA, 27 nt, synthetic construct
  misc_feature 1..27: note = derived and/or modified sequence opt2 from anti-influenza_CDR
  source 1..27: mol_type = other RNA
cagcagtacaactcctggccccgcacc

SEQ ID NO: 22181 - RNA, 27 nt, synthetic construct
  misc_feature 1..27: note = derived and/or modified sequence opt2 from anti-influenza_CDR
  source 1..27: mol_type = other RNA
gtcatctactcccacggccgcgcctac

SEQ ID NO: 22182 - RNA, 27 nt, synthetic construct
  misc_feature 1..27: note = derived and/or modified sequence opt2 from anti-influenza_CDR
  source 1..27: mol_type = other RNA
cagcagtacggcgactcccgctacacc

SEQ ID NO: 22183 - RNA, 27 nt, synthetic construct
  misc_feature 1..27: note = derived and/or modified sequence opt2 from anti-influenza_CDR
  source 1..27: mol_type = other RNA
ctccagcacaactcctacccctacacc

SEQ ID NO: 22184 - RNA, 27 nt, synthetic construct
  misc_feature 1..27: note = derived and/or modified sequence opt2 from anti-influenza_CDR
  source 1..27: mol_type = other RNA
cgcaagatgaccaccgccttcgactcc

SEQ ID NO: 22185 - RNA, 27 nt, synthetic construct
  misc_feature 1..27: note = derived and/or modified sequence opt2 from anti-influenza_CDR
  source 1..27: mol_type = other RNA
cagcgcaaccactccccctcctggacc

SEQ ID NO: 22186 - RNA, 27 nt, synthetic construct
  misc_feature 1..27: note = derived and/or modified sequence opt2 from anti-influenza_CDR
  source 1..27: mol_type = other RNA
cagcagtcctacgacaacccccagacc

SEQ ID NO: 22187 - RNA, 27 nt, synthetic construct
  misc_feature 1..27: note = derived and/or modified sequence opt2 from anti-influenza_CDR
  source 1..27: mol_type = other RNA
cagcagtcccgccgcctcccctacacc

SEQ ID NO: 22188 - RNA, 27 nt, synthetic construct
  misc_feature 1..27: note = derived and/or modified sequence opt2 from anti-influenza_CDR
  source 1..27: mol_type = other RNA
cgcaagatgaccaccgccatcgactac

SEQ ID NO: 22189 - RNA, 27 nt, synthetic construct
  misc_feature 1..27: note = derived and/or modified sequence opt2 from anti-influenza_CDR
  source 1..27: mol_type = other RNA
atccgctacaccggccagcagctcctc

SEQ ID NO: 22190 - RNA, 27 nt, synthetic construct
  misc_feature 1..27: note = derived and/or modified sequence opt2 from anti-influenza_CDR
  source 1..27: mol_type = other RNA
cagcactacggcaccatctcccagacc

SEQ ID NO: 22191 - RNA, 27 nt, synthetic construct
  misc_feature 1..27: note = derived and/or modified sequence opt2 from anti-influenza_CDR
  source 1..27: mol_type = other RNA
cagcagtactccacctccccccccacc

SEQ ID NO: 22192 - RNA, 27 nt, synthetic construct
  misc_feature 1..27: note = derived and/or modified sequence opt2 from anti-influenza_CDR
  source 1..27: mol_type = other RNA
cagcagtacggcaactcccccatcacc

SEQ ID NO: 22193 - RNA, 27 nt, synthetic construct
  misc_feature 1..27: note = derived and/or modified sequence opt2 from anti-influenza_CDR
  source 1..27: mol_type = other RNA
cagcagtactactcccgcccctacacc

SEQ ID NO: 22194 - RNA, 27 nt, synthetic construct
  misc_feature 1..27: note = derived and/or modified sequence opt2 from anti-influenza_CDR
  source 1..27: mol_type = other RNA
caggtctgggacaacttcggcggcgtc

SEQ ID NO: 22195 - RNA, 27 nt, synthetic construct
  misc_feature 1..27: note = derived and/or modified sequence opt2 from anti-influenza_CDR
  source 1..27: mol_type = other RNA
cagcagtcctactcctcccccctcacc

SEQ ID NO: 22196 - RNA, 27 nt, synthetic construct
  misc_feature 1..27: note = derived and/or modified sequence opt2 from anti-influenza_CDR
  source 1..27: mol_type = other RNA
cagcagtacttcgccaccccccgcacc

SEQ ID NO: 22197 - RNA, 27 nt, synthetic construct
  misc_feature 1..27: note = derived and/or modified sequence opt2 from anti-influenza_CDR
  source 1..27: mol_type = other RNA
cagcagtactacttctcccccctcacc

SEQ ID NO: 22198 - RNA, 27 nt, synthetic construct
  misc_feature 1..27: note = derived and/or modified sequence opt2 from anti-influenza_CDR
  source 1..27: mol_type = other RNA
cagcacttcggcacctccgtcttcacc

SEQ ID NO: 22199 - RNA, 27 nt, synthetic construct
  misc_feature 1..27: note = derived and/or modified sequence opt2 from anti-influenza_CDR
  source 1..27: mol_type = other RNA
cagcagtactacaacgcccccctcacc

SEQ ID NO: 22200 - RNA, 27 nt, synthetic construct
  misc_feature 1..27: note = derived and/or modified sequence opt2 from anti-influenza_CDR
  source 1..27: mol_type = other RNA
gtcctcttcacctcccccttcgacttc

SEQ ID NO: 22201 - RNA, 27 nt, synthetic construct
  misc_feature 1..27: note = derived and/or modified sequence opt2 from anti-influenza_CDR
  source 1..27: mol_type = other RNA
ctcctctcctactccggcgtctgggtc

SEQ ID NO: 22202 - RNA, 27 nt, synthetic construct
  misc_feature 1..27: note = derived and/or modified sequence opt2 from anti-influenza_CDR
  source 1..27: mol_type = other RNA
ttcctctcctactccggcgcctgggtc

SEQ ID NO: 22203 - RNA, 27 nt, synthetic construct
  misc_feature 1..27: note = derived and/or modified sequence opt2 from anti-influenza_CDR
  source 1..27: mol_type = other RNA
cagcagtccttctccaagtcctggacc

SEQ ID NO: 22204 - RNA, 27 nt, synthetic construct
  misc_feature 1..27: note = derived and/or modified sequence opt2 from anti-influenza_CDR
  source 1..27: mol_type = other RNA
gtccagtacgtccagttcccctggacc

SEQ ID NO: 22205 - RNA, 27 nt, synthetic construct
  misc_feature 1..27: note = derived and/or modified sequence opt2 from anti-influenza_CDR
  source 1..27: mol_type = other RNA
cagcagtcctactccccccccctcacc

SEQ ID NO: 22206 - RNA, 27 nt, synthetic construct
  misc_feature 1..27: note = derived and/or modified sequence opt2 from anti-influenza_CDR
  source 1..27: mol_type = other RNA
ttcatctactacggcggcaacaccaag

SEQ ID NO: 22207 - RNA, 27 nt, synthetic construct
  misc_feature 1..27: note = derived and/or modified sequence opt2 from anti-influenza_CDR
  source 1..27: mol_type = other RNA
gtcatctactccggcggctccacctac

SEQ ID NO: 22208 - RNA, 27 nt, synthetic construct
  misc_feature 1..27: note = derived and/or modified sequence opt2 from anti-influenza_CDR
  source 1..27: mol_type = other RNA
ttcatgttccactccggctccccccgc

SEQ ID NO: 22209 - RNA, 27 nt, synthetic construct
  misc_feature 1..27: note = derived and/or modified sequence opt2 from anti-influenza_CDR
  source 1..27: mol_type = other RNA
cagcagacctactccacccccatcacc

SEQ ID NO: 22210 - RNA, 27 nt, synthetic construct
  misc_feature 1..27: note = derived and/or modified sequence opt2 from anti-influenza_CDR
  source 1..27: mol_type = other RNA
ttcttctacaacggcggctccaccaag

SEQ ID NO: 22211 - RNA, 27 nt, synthetic construct
  misc_feature 1..27: note = derived and/or modified sequence opt2 from anti-influenza_CDR
  source 1..27: mol_type = other RNA
cagcagtcctacaacacccccctcatc

SEQ ID NO: 22212 - RNA, 27 nt, synthetic construct
  misc_feature 1..27: note = derived and/or modified sequence opt2 from anti-influenza_CDR
  source 1..27: mol_type = other RNA
cacatctacgactacggccgcaccttc

SEQ ID NO: 22213 - RNA, 27 nt, synthetic construct
  misc_feature 1..27: note = derived and/or modified sequence opt2 from anti-influenza_CDR
  source 1..27: mol_type = other RNA
gtcttctactccgagacccgcacctac

SEQ ID NO: 22214 - RNA, 27 nt, synthetic construct
  misc_feature 1..27: note = derived and/or modified sequence opt2 from anti-influenza_CDR
  source 1..27: mol_type = other RNA
caggtctggggctcctcctccgaccac

SEQ ID NO: 22215 - RNA, 27 nt, synthetic construct
  misc_feature 1..27: note = derived and/or modified sequence opt2 from anti-influenza_CDR
  source 1..27: mol_type = other RNA
tacgtctacaaccgcggctccaccaag

SEQ ID NO: 22216 - RNA, 27 nt, synthetic construct
  misc_feature 1..27: note = derived and/or modified sequence opt2 from anti-influenza_CDR
  source 1..27: mol_type = other RNA
tacatctacaaccgcggctccaccaag

SEQ ID NO: 22217 - RNA, 27 nt, synthetic construct
  misc_feature 1..27: note = derived and/or modified sequence opt2 from anti-influenza_CDR
  source 1..27: mol_type = other RNA
cagcagtcctacaacacccccatcacc

SEQ ID NO: 22218 - RNA, 27 nt, synthetic construct
  misc_feature 1..27: note = derived and/or modified sequence opt2 from anti-influenza_CDR
  source 1..27: mol_type = other RNA
cagcagtactactcctccccccccacc

SEQ ID NO: 22219 - RNA, 27 nt, synthetic construct
  misc_feature 1..27: note = derived and/or modified sequence opt2 from anti-influenza_CDR
  source 1..27: mol_type = other RNA
tacctctactactccggctccaccaag

SEQ ID NO: 22220 - RNA, 27 nt, synthetic construct
  misc_feature 1..27: note = derived and/or modified sequence opt2 from anti-influenza_CDR
  source 1..27: mol_type = other RNA
cagcagtcctactccccccccatcacc

SEQ ID NO: 22221 - RNA, 27 nt, synthetic construct
  misc_feature 1..27: note = derived and/or modified sequence opt2 from anti-influenza_CDR
  source 1..27: mol_type = other RNA
tacgtctacaactccggcaacaccaag

SEQ ID NO: 22222 - RNA, 27 nt, synthetic construct
  misc_feature 1..27: note = derived and/or modified sequence opt2 from anti-influenza_CDR
  source 1..27: mol_type = other RNA
cagcagtcctacaacacccccctcacc

SEQ ID NO: 22223 - RNA, 27 nt, synthetic construct
  misc_feature 1..27: note = derived and/or modified sequence opt2 from anti-influenza_CDR
  source 1..27: mol_type = other RNA
cacatcttcgactccggctccacctac

SEQ ID NO: 22224 - RNA, 27 nt, synthetic construct
  misc_feature 1..27: note = derived and/or modified sequence opt2 from anti-influenza_CDR
  source 1..27: mol_type = other RNA
gtcttctactccgccgaccgcacctcc

SEQ ID NO: 22225 - RNA, 27 nt, synthetic construct
  misc_feature 1..27: note = derived and/or modified sequence opt2 from anti-influenza_CDR
  source 1..27: mol_type = other RNA
cagcagtactactccacccccctcacc

SEQ ID NO: 22226 - RNA, 27 nt, synthetic construct
  misc_feature 1..27: note = derived and/or modified sequence opt2 from anti-influenza_CDR
  source 1..27: mol_type = other RNA
tacatctactactccggcaacacctac

SEQ ID NO: 22227 - RNA, 27 nt, synthetic construct
  misc_feature 1..27: note = derived and/or modified sequence opt2 from anti-influenza_CDR
  source 1..27: mol_type = other RNA
cagcagtcctactccacccccctcacc

SEQ ID NO: 22228 - RNA, 27 nt, synthetic construct
  misc_feature 1..27: note = derived and/or modified sequence opt2 from anti-influenza_CDR
  source 1..27: mol_type = other RNA
cagcagtacggctcctcctccctcacc

SEQ ID NO: 22229 - RNA, 27 nt, synthetic construct
  misc_feature 1..27: note = derived and/or modified sequence opt2 from anti-influenza_CDR
  source 1..27: mol_type = other RNA
tcctcctacacctcctcctccacctac

SEQ ID NO: 22230 - RNA, 27 nt, synthetic construct
  misc_feature 1..27: note = derived and/or modified sequence opt2 from anti-influenza_CDR
  source 1..27: mol_type = other RNA
cagcgctacaactccgccccccccatc

SEQ ID NO: 22231 - RNA, 27 nt, synthetic construct
  misc_feature 1..27: note = derived and/or modified sequence opt2 from anti-influenza_CDR
  source 1..27: mol_type = other RNA
cagcagtacggccgcacccccctcacc

SEQ ID NO: 22232 - RNA, 27 nt, synthetic construct
  misc_feature 1..27: note = derived and/or modified sequence opt2 from anti-influenza_CDR
  source 1..27: mol_type = other RNA
cagcagtacggctcctccccccgcacc

SEQ ID NO: 22233 - RNA, 27 nt, synthetic construct
  misc_feature 1..27: note = derived and/or modified sequence opt2 from anti-influenza_CDR
  source 1..27: mol_type = other RNA
cagcagtacggctcctcccccctcacc

SEQ ID NO: 22234 - RNA, 27 nt, synthetic construct
  misc_feature 1..27: note = derived and/or modified sequence opt2 from anti-influenza_CDR
  source 1..27: mol_type = other RNA
caggtctgggactcctcctccgaccac

SEQ ID NO: 22235 - RNA, 27 nt, synthetic construct
  misc_feature 1..27: note = derived and/or modified sequence opt2 from anti-influenza_CDR
  source 1..27: mol_type = other RNA
aaggagttctccgaggtcgagggccgc

SEQ ID NO: 22236 - RNA, 27 nt, synthetic construct
  misc_feature 1..27: note = derived and/or modified sequence opt2 from anti-influenza_CDR
  source 1..27: mol_type = other RNA
aaggagttcaacaacctcgagaagcgc

SEQ ID NO: 22237 - RNA, 27 nt, synthetic construct
  misc_feature 1..27: note = derived and/or modified sequence opt2 from anti-influenza_CDR
  source 1..27: mol_type = other RNA
cagcagcactaccgcacccccccctcc

SEQ ID NO: 22238 - RNA, 27 nt, synthetic construct
  misc_feature 1..27: note = derived and/or modified sequence opt2 from anti-influenza_CDR
  source 1..27: mol_type = other RNA
atgcaggccacccactggcccctcacc

SEQ ID NO: 22239 - RNA, 27 nt, synthetic construct
  misc_feature 1..27: note = derived and/or modified sequence opt2 from anti-influenza_CDR
  source 1..27: mol_type = other RNA
cagcagtactactcctacccctacacc

SEQ ID NO: 22240 - RNA, 27 nt, synthetic construct
  misc_feature 1..27: note = derived and/or modified sequence opt2 from anti-influenza_CDR
  source 1..27: mol_type = other RNA
tcctccgacgtcggcggctacaactac

SEQ ID NO: 22241 - RNA, 27 nt, synthetic construct
  misc_feature 1..27: note = derived and/or modified sequence opt2 from anti-influenza_CDR
  source 1..27: mol_type = other RNA
tcctccgacgtcggcgactacaactac

SEQ ID NO: 22242 - RNA, 27 nt, synthetic construct
  misc_feature 1..27: note = derived and/or modified sequence opt2 from anti-influenza_CDR
  source 1..27: mol_type = other RNA
cagcagtacaacaactggcccctctcc

SEQ ID NO: 22243 - RNA, 27 nt, synthetic construct
  misc_feature 1..27: note = derived and/or modified sequence opt2 from anti-influenza_CDR
  source 1..27: mol_type = other RNA
cagcagtcctacaactacccccgcacc

SEQ ID NO: 22244 - RNA, 27 nt, synthetic construct
  misc_feature 1..27: note = derived and/or modified sequence opt2 from anti-influenza_CDR
  source 1..27: mol_type = other RNA
atgcagggcctccagaccccctacacc

SEQ ID NO: 22245 - RNA, 27 nt, synthetic construct
  misc_feature 1..27: note = derived and/or modified sequence opt2 from anti-influenza_CDR
  source 1..27: mol_type = other RNA
cagcagcactactccatccccctcacc

SEQ ID NO: 22246 - RNA, 27 nt, synthetic construct
  misc_feature 1..27: note = derived and/or modified sequence opt2 from anti-influenza_CDR
  source 1..27: mol_type = other RNA
ctccagcacaactcctacccctggacc

SEQ ID NO: 22247 - RNA, 27 nt, synthetic construct
  misc_feature 1..27: note = derived and/or modified sequence opt2 from anti-influenza_CDR
  source 1..27: mol_type = other RNA
cagcagtacaacacctggcccctcacc

SEQ ID NO: 22248 - RNA, 27 nt, synthetic construct
  misc_feature 1..27: note = derived and/or modified sequence opt2 from anti-influenza_CDR
  source 1..27: mol_type = other RNA
cagcagtacaactccttcccctaccgc

SEQ ID NO: 22249 - RNA, 27 nt, synthetic construct
  misc_feature 1..27: note = derived and/or modified sequence opt2 from anti-influenza_CDR
  source 1..27: mol_type = other RNA
cagcagtcctactccgcccccttcacc

SEQ ID NO: 22250 - RNA, 27 nt, synthetic construct
  misc_feature 1..27: note = derived and/or modified sequence opt2 from anti-influenza_CDR
  source 1..27: mol_type = other RNA
caggcctgggactcctccaccgtcgtc

SEQ ID NO: 22251 - RNA, 27 nt, synthetic construct
  misc_feature 1..27: note = derived and/or modified sequence opt2 from anti-influenza_CDR
  source 1..27: mol_type = other RNA
caggcctgggactccaccaccgtcgtc

SEQ ID NO: 22252 - RNA, 27 nt, synthetic construct
  misc_feature 1..27: note = derived and/or modified sequence opt2 from anti-influenza_CDR
  source 1..27: mol_type = other RNA
ctccagtacggctcctccccccgcacc

SEQ ID NO: 22253 - RNA, 27 nt, synthetic construct
  misc_feature 1..27: note = derived and/or modified sequence opt2 from anti-influenza_CDR
  source 1..27: mol_type = other RNA
tcctccgacgtcggcggctacgactac

SEQ ID NO: 22254 - RNA, 27 nt, synthetic construct
  misc_feature 1..27: note = derived and/or modified sequence opt2 from anti-influenza_CDR
  source 1..27: mol_type = other RNA
cagcagtacacctactggcccctcacc

SEQ ID NO: 22255 - RNA, 27 nt, synthetic construct
  misc_feature 1..27: note = derived and/or modified sequence opt2 from anti-influenza_CDR
  source 1..27: mol_type = other RNA
cagcagtacgacaagtggccccccggc

SEQ ID NO: 22256 - RNA, 27 nt, synthetic construct
  misc_feature 1..27: note = derived and/or modified sequence opt2 from anti-influenza_CDR
  source 1..27: mol_type = other RNA
atgcagtccctccagacctccatcacc

SEQ ID NO: 22257 - RNA, 27 nt, synthetic construct
  misc_feature 1..27: note = derived and/or modified sequence opt2 from anti-influenza_CDR
  source 1..27: mol_type = other RNA
tcccagatcgagctcgccgtcctcctc

SEQ ID NO: 22258 - RNA, 27 nt, synthetic construct
  misc_feature 1..27: note = derived and/or modified sequence opt2 from anti-influenza_CDR
  source 1..27: mol_type = other RNA
atgcaggccctccagaccccctacacc

SEQ ID NO: 22259 - RNA, 27 nt, synthetic construct
  misc_feature 1..27: note = derived and/or modified sequence opt2 from anti-influenza_CDR
  source 1..27: mol_type = other RNA
cagcagcgctcccactggccccccatc

SEQ ID NO: 22260 - RNA, 27 nt, synthetic construct
  misc_feature 1..27: note = derived and/or modified sequence opt2 from anti-influenza_CDR
  source 1..27: mol_type = other RNA
cagcacttctggggcacccccctcacc

SEQ ID NO: 22261 - RNA, 27 nt, synthetic construct
  misc_feature 1..27: note = derived and/or modified sequence opt2 from anti-influenza_CDR
  source 1..27: mol_type = other RNA
cagcagaactacgaggacccctggacc

SEQ ID NO: 22262 - RNA, 27 nt, synthetic construct
  misc_feature 1..27: note = derived and/or modified sequence opt2 from anti-influenza_CDR
  source 1..27: mol_type = other RNA
cagcaggccaactccttcccccccacc

SEQ ID NO: 22263 - RNA, 27 nt, synthetic construct
  misc_feature 1..27: note = derived and/or modified sequence opt2 from anti-influenza_CDR
  source 1..27: mol_type = other RNA
cagcagcgcgaccactggccccccatc

SEQ ID NO: 22264 - RNA, 27 nt, synthetic construct
  misc_feature 1..27: note = derived and/or modified sequence opt2 from anti-influenza_CDR
  source 1..27: mol_type = other RNA
atggactcccgcctcaacctcgtcttc

SEQ ID NO: 22265 - RNA, 27 nt, synthetic construct
  misc_feature 1..27: note = derived and/or modified sequence opt2 from anti-influenza_CDR
  source 1..27: mol_type = other RNA
atgaagctccccgtccgcctcctcgtc

SEQ ID NO: 22266 - RNA, 30 nt, synthetic construct
  misc_feature 1..30: note = derived and/or modified sequence opt2 from anti-influenza_CDR
  source 1..30: mol_type = other RNA
ggcgactccgtcacccgcggcggcttctac

SEQ ID NO: 22267 - RNA, 30 nt, synthetic construct
  misc_feature 1..30: note = derived and/or modified sequence opt2 from anti-influenza_CDR
  source 1..30: mol_type = other RNA
cagtccgtcaccttcaacaacaagaactac

SEQ ID NO: 22268 - RNA, 30 nt, synthetic construct
  misc_feature 1..30: note = derived and/or modified sequence opt2 from anti-influenza_CDR
  source 1..30: mol_type = other RNA
cagtccgtcaccttcaactacaagaactac

SEQ ID NO: 22269 - RNA, 30 nt, synthetic construct
  misc_feature 1..30: note = derived and/or modified sequence opt2 from anti-influenza_CDR
  source 1..30: mol_type = other RNA
cgcgcccagtccctctcctcctacctccac

SEQ ID NO: 22270 - RNA, 30 nt, synthetic construct
  misc_feature 1..30: note = derived and/or modified sequence opt2 from anti-influenza_CDR
  source 1..30: mol_type = other RNA
tcctcctacacctcctcctccacctacgtc

SEQ ID NO: 22271 - RNA, 30 nt, synthetic construct
  misc_feature 1..30: note = derived and/or modified sequence opt2 from anti-influenza_CDR
  source 1..30: mol_type = other RNA
cagcgctacaactccgccccccccatcacc

SEQ ID NO: 22272 - RNA, 30 nt, synthetic construct
  misc_feature 1..30: note = derived and/or modified sequence opt2 from anti-influenza_CDR
  source 1..30: mol_type = other RNA
ggcggctccatctcctccggcacctactac

SEQ ID NO: 22273 - RNA, 30 nt, synthetic construct
  misc_feature 1..30: note = derived and/or modified sequence opt2 from anti-influenza_CDR
  source 1..30: mol_type = other RNA
cagcagtcctactcctccctcatgttcacc

SEQ ID NO: 22274 - RNA, 30 nt, synthetic construct
  misc_feature 1..30: note = derived and/or modified sequence opt2 from anti-influenza_CDR
  source 1..30: mol_type = other RNA
ctcctcatctacggcgcctccacccgcgcc

SEQ ID NO: 22275 - RNA, 30 nt, synthetic construct
  misc_feature 1..30: note = derived and/or modified sequence opt2 from anti-influenza_CDR
  source 1..30: mol_type = other RNA
tgcgcctacggcggcaagtacctcgtcgtc

SEQ ID NO: 22276 - RNA, 30 nt, synthetic construct; identical to SEQ ID NO: 14634
  misc_feature 1..30: note = derived and/or modified sequence opt2 from anti-influenza_CDR
  source 1..30: mol_type = other RNA

SEQ ID NO: 22277 - RNA, 30 nt, synthetic construct
  misc_feature 1..30: note = derived and/or modified sequence opt2 from anti-influenza_CDR
  source 1..30: mol_type = other RNA
cagcactacggctactccccccgctacgcc

SEQ ID NO: 22278 - RNA, 30 nt, synthetic construct
  misc_feature 1..30: note = derived and/or modified sequence opt2 from anti-influenza_CDR
  source 1..30: mol_type = other RNA
cagcagcgctcccactggccccccatcacc

SEQ ID NO: 22279 - RNA, 30 nt, synthetic construct
  misc_feature 1..30: note = derived and/or modified sequence opt2 from anti-influenza_CDR
  source 1..30: mol_type = other RNA
tcctcctacgccggctcctccacctgggtc

SEQ ID NO: 22280 - RNA, 30 nt, synthetic construct
  misc_feature 1..30: note = derived and/or modified sequence opt2 from anti-influenza_CDR
  source 1..30: mol_type = other RNA
ctcctctactccggcggcgaccccgtcgcc

SEQ ID NO: 22281 - RNA, 30 nt, synthetic construct
  misc_feature 1..30: note = derived and/or modified sequence opt2 from anti-influenza_CDR
  source 1..30: mol_type = other RNA
cagcagtacggcggctccccccgctacacc

SEQ ID NO: 22282 - RNA, 30 nt, synthetic construct
  misc_feature 1..30: note = derived and/or modified sequence opt2 from anti-influenza_CDR
  source 1..30: mol_type = other RNA
cgctacggctccggctacggcttcgactcc

SEQ ID NO: 22283 - RNA, 30 nt, synthetic construct
  misc_feature 1..30: note = derived and/or modified sequence opt2 from anti-influenza_CDR
  source 1..30: mol_type = other RNA
tcctcctacgccggcaactacaaccacgtc

SEQ ID NO: 22284 - RNA, 30 nt, synthetic construct
  misc_feature 1..30: note = derived and/or modified sequence opt2 from anti-influenza_CDR
  source 1..30: mol_type = other RNA
cagcagtacatcaactggcgccccctctcc

SEQ ID NO: 22285 - RNA, 30 nt, synthetic construct
  misc_feature 1..30: note = derived and/or modified sequence opt2 from anti-influenza_CDR
  source 1..30: mol_type = other RNA
atcggcgccggctacgacgtccactggtac

SEQ ID NO: 22286 - RNA, 30 nt, synthetic construct
  misc_feature 1..30: note = derived and/or modified sequence opt2 from anti-influenza_CDR
  source 1..30: mol_type = other RNA
ctcctcatctacgacaacaacaaccgcccc

SEQ ID NO: 22287 - RNA, 30 nt, synthetic construct
  misc_feature 1..30: note = derived and/or modified sequence opt2 from anti-influenza_CDR
  source 1..30: mol_type = other RNA
cagtcctacgacaactccctctccggctcc

SEQ ID NO: 22288 - RNA, 30 nt, synthetic construct
  misc_feature 1..30: note = derived and/or modified sequence opt2 from anti-influenza_CDR
  source 1..30: mol_type = other RNA
ctcctcatctacgacgcctccaacctccag

SEQ ID NO: 22289 - RNA, 30 nt, synthetic construct
  misc_feature 1..30: note = derived and/or modified sequence opt2 from anti-influenza_CDR
  source 1..30: mol_type = other RNA
ctcctcatccacgacgcctccaacctcgag

SEQ ID NO: 22290 - RNA, 30 nt, synthetic construct
  misc_feature 1..30: note = derived and/or modified sequence opt2 from anti-influenza_CDR
  source 1..30: mol_type = other RNA
gtccagcgcctctcctacggcatggacgtc

SEQ ID NO: 22291 - RNA, 30 nt, synthetic construct
  misc_feature 1..30: note = derived and/or modified sequence opt2 from anti-influenza_CDR
  source 1..30: mol_type = other RNA
gtccagaagtcctactacggcatggacgtc

SEQ ID NO: 22292 - RNA, 30 nt, synthetic construct
  misc_feature 1..30: note = derived and/or modified sequence opt2 from anti-influenza_CDR
  source 1..30: mol_type = other RNA
tcctcctacacctcctcctccacccacgtc

SEQ ID NO: 22293 - RNA, 30 nt, synthetic construct
  misc_feature 1..30: note = derived and/or modified sequence opt2 from anti-influenza_CDR
  source 1..30: mol_type = other RNA
tcctcctacacctcctcctccaccctcgtc

SEQ ID NO: 22294 - RNA, 30 nt, synthetic construct
  misc_feature 1..30: note = derived and/or modified sequence opt2 from anti-influenza_CDR
  source 1..30: mol_type = other RNA
accaagcgctcccagcagaccgtcatcccc

SEQ ID NO: 22295 - RNA, 30 nt, synthetic construct
  misc_feature 1..30: note = derived and/or modified sequence opt2 from anti-influenza_CDR
  source 1..30: mol_type = other RNA
acctcccgctcccagcagaccgtcatcccc

SEQ ID NO: 22296 - RNA, 30 nt, synthetic construct
  misc_feature 1..30: note = derived and/or modified sequence opt2 from anti-influenza_CDR
  source 1..30: mol_type = other RNA
tcctccaactacaaccgccgcttcaccccc

SEQ ID NO: 22297 - RNA, 30 nt, synthetic construct
  misc_feature 1..30: note = derived and/or modified sequence opt2 from anti-influenza_CDR
  source 1..30: mol_type = other RNA
cgccccaaggtccgcgaccaggagtcccgc

SEQ ID NO: 22298 - RNA, 30 nt, synthetic construct
  misc_feature 1..30: note = derived and/or modified sequence opt2 from anti-influenza_CDR
  source 1..30: mol_type = other RNA
cgcccctgggtccgcggcgtctcctcccgc

SEQ ID NO: 22299 - RNA, 30 nt, synthetic construct
  misc_feature 1..30: note = derived and/or modified sequence opt2 from anti-influenza_CDR
  source 1..30: mol_type = other RNA
cgcccctgggtccgcggcctctcctcccgc

SEQ ID NO: 22300 - RNA, 30 nt, synthetic construct
  misc_feature 1..30: note = derived and/or modified sequence opt2 from anti-influenza_CDR
  source 1..30: mol_type = other RNA
cgccccaaggtccgcggccaggccggccgc

SEQ ID NO: 22301 - RNA, 30 nt, synthetic construct
  misc_feature 1..30: note = derived and/or modified sequence opt2 from anti-influenza_CDR
  source 1..30: mol_type = other RNA
gcccccgccgtcgccgcccaggcctccgcc

SEQ ID NO: 22302 - RNA, 30 nt, synthetic construct
  misc_feature 1..30: note = derived and/or modified sequence opt2 from anti-influenza_CDR
  source 1..30: mol_type = other RNA
gtccaccaccccggcaccgacaacgaccag

SEQ ID NO: 22303 - RNA, 30 nt, synthetic construct
  misc_feature 1..30: note = derived and/or modified sequence opt2 from anti-influenza_CDR
  source 1..30: mol_type = other RNA
ttcggccagggcaccaaggtcgagatcaag

SEQ ID NO: 22304 - RNA, 30 nt, synthetic construct; identical to SEQ ID NO: 14662
  misc_feature 1..30: note = derived and/or modified sequence opt2 from anti-influenza_CDR
  source 1..30: mol_type = other RNA

SEQ ID NO: 22305 - RNA, 30 nt, synthetic construct
  misc_feature 1..30: note = derived and/or modified sequence opt2 from anti-influenza_CDR
  source 1..30: mol_type = other RNA
ggcctcaccttctcctcctacgccgtccac

SEQ ID NO: 22306 - RNA, 30 nt, synthetic construct
  misc_feature 1..30: note = derived and/or modified sequence opt2 from anti-influenza_CDR
  source 1..30: mol_type = other RNA
ggccccaccttctcctcctacgccgtccac

SEQ ID NO: 22307 - RNA, 30 nt, synthetic construct
  misc_feature 1..30: note = derived and/or modified sequence opt2 from anti-influenza_CDR
  source 1..30: mol_type = other RNA
ggctccatcttctccaactacggcatctcc

SEQ ID NO: 22308 - RNA, 30 nt, synthetic construct
  misc_feature 1..30: note = derived and/or modified sequence opt2 from anti-influenza_CDR
  source 1..30: mol_type = other RNA
ggctactccttcaacaactacggcatcaac

SEQ ID NO: 22309 - RNA, 30 nt, synthetic construct; identical to SEQ ID NO: 14667
  misc_feature 1..30: note = derived and/or modified sequence opt2 from anti-influenza_CDR
  source 1..30: mol_type = other RNA

SEQ ID NO: 22310 - RNA, 30 nt, synthetic construct
  misc_feature 1..30: note = derived and/or modified sequence opt2 from anti-influenza_CDR
  source 1..30: mol_type = other RNA
ggctacaccttcacctccttcatcatgtac

SEQ ID NO: 22311 - RNA, 30 nt, synthetic construct
  misc_feature 1..30: note = derived and/or modified sequence opt2 from anti-influenza_CDR
  source 1..30: mol_type = other RNA
cgcggcaactacggcaacggcttcgcctac

SEQ ID NO: 22312 - RNA, 30 nt, synthetic construct
  misc_feature 1..30: note = derived and/or modified sequence opt2 from anti-influenza_CDR
  source 1..30: mol_type = other RNA
cagcagtacggctcctcccccgccctcacc

SEQ ID NO: 22313 - RNA, 30 nt, synthetic construct
  misc_feature 1..30: note = derived and/or modified sequence opt2 from anti-influenza_CDR
  source 1..30: mol_type = other RNA
caggagtacaacaacgactcccccctcacc

SEQ ID NO: 22314 - RNA, 30 nt, synthetic construct
  misc_feature 1..30: note = derived and/or modified sequence opt2 from anti-influenza_CDR
  source 1..30: mol_type = other RNA
atccgctccggcctcaaccgcttcgagacc

SEQ ID NO: 22315 - RNA, 30 nt, synthetic construct
  misc_feature 1..30: note = derived and/or modified sequence opt2 from anti-influenza_CDR
  source 1..30: mol_type = other RNA
gtcttctactccggctcctccaactacaac

SEQ ID NO: 22316 - RNA, 30 nt, synthetic construct
  misc_feature 1..30: note = derived and/or modified sequence opt2 from anti-influenza_CDR
  source 1..30: mol_type = other RNA
ggcgcctccatctccaccggcggcaactac

SEQ ID NO: 22317 - RNA, 30 nt, synthetic construct
  misc_feature 1..30: note = derived and/or modified sequence opt2 from anti-influenza_CDR
  source 1..30: mol_type = other RNA
atcttctactccggcaccaccaagtacaac

SEQ ID NO: 22318 - RNA, 30 nt, synthetic construct
  misc_feature 1..30: note = derived and/or modified sequence opt2 from anti-influenza_CDR
  source 1..30: mol_type = other RNA
gcctcctacgccggcacctacatccacctc

SEQ ID NO: 22319 - RNA, 30 nt, synthetic construct
  misc_feature 1..30: note = derived and/or modified sequence opt2 from anti-influenza_CDR
  source 1..30: mol_type = other RNA
cagcagctcaactcctacccccccatcacc

SEQ ID NO: 22320 - RNA, 30 nt, synthetic construct
  misc_feature 1..30: note = derived and/or modified sequence opt2 from anti-influenza_CDR
  source 1..30: mol_type = other RNA
cagcagttcaacgactggcccttcctcacc

SEQ ID NO: 22321 - RNA, 30 nt, synthetic construct
  misc_feature 1..30: note = derived and/or modified sequence opt2 from anti-influenza_CDR
  source 1..30: mol_type = other RNA
cagcagctcaccacctacccccccatcacc

SEQ ID NO: 22322 - RNA, 30 nt, synthetic construct
  misc_feature 1..30: note = derived and/or modified sequence opt2 from anti-influenza_CDR
  source 1..30: mol_type = other RNA
ggcggctccatctccaacggcggctaccac

SEQ ID NO: 22323 - RNA, 30 nt, synthetic construct
  misc_feature 1..30: note = derived and/or modified sequence opt2 from anti-influenza_CDR
  source 1..30: mol_type = other RNA
ggcgactccgtcatcaactccgcctactac

SEQ ID NO: 22324 - RNA, 30 nt, synthetic construct
  misc_feature 1..30: note = derived and/or modified sequence opt2 from anti-influenza_CDR
  source 1..30: mol_type = other RNA
cagcagtacgacaactggctccccatcacc

SEQ ID NO: 22325 - RNA, 30 nt, synthetic construct
  misc_feature 1..30: note = derived and/or modified sequence opt2 from anti-influenza_CDR
  source 1..30: mol_type = other RNA
gccggcgactactccggcggcatctacgcc

SEQ ID NO: 22326 - RNA, 30 nt, synthetic construct
  misc_feature 1..30: note = derived and/or modified sequence opt2 from anti-influenza_CDR
  source 1..30: mol_type = other RNA
gccggcgactactccggctccaactacgcc

SEQ ID NO: 22327 - RNA, 30 nt, synthetic construct
  misc_feature 1..30: note = derived and/or modified sequence opt2 from anti-influenza_CDR
  source 1..30: mol_type = other RNA
gccggcgactactccggcgccaactacgcc

SEQ ID NO: 22328 - RNA, 30 nt, synthetic construct
  misc_feature 1..30: note = derived and/or modified sequence opt2 from anti-influenza_CDR
  source 1..30: mol_type = other RNA
ggcctctccctctactccaacgagatcaac

SEQ ID NO: 22329 - RNA, 30 nt, synthetic construct
  misc_feature 1..30: note = derived and/or modified sequence opt2 from anti-influenza_CDR
  source 1..30: mol_type = other RNA
gcctcctacgccggcaacaacatctacgtc

SEQ ID NO: 22330 - RNA, 30 nt, synthetic construct
  misc_feature 1..30: note = derived and/or modified sequence opt2 from anti-influenza_CDR
  source 1..30: mol_type = other RNA
gcctcccagtccgtctccaccttcctcgcc

SEQ ID NO: 22331 - RNA, 30 nt, synthetic construct
  misc_feature 1..30: note = derived and/or modified sequence opt2 from anti-influenza_CDR
  source 1..30: mol_type = other RNA
atcaagtccaacaccgacggcggcaccacc

SEQ ID NO: 22332 - RNA, 30 nt, synthetic construct
  misc_feature 1..30: note = derived and/or modified sequence opt2 from anti-influenza_CDR
  source 1..30: mol_type = other RNA
gagtccgtcgacatctacggcaactccttc

SEQ ID NO: 22333 - RNA, 30 nt, synthetic construct
  misc_feature 1..30: note = derived and/or modified sequence opt2 from anti-influenza_CDR
  source 1..30: mol_type = other RNA
gagtccatcgacatctacggcaactccttc

SEQ ID NO: 22334 - RNA, 30 nt, synthetic construct
  misc_feature 1..30: note = derived and/or modified sequence opt2 from anti-influenza_CDR
  source 1..30: mol_type = other RNA
gccggcgactactccggcgtcaactacgcc

SEQ ID NO: 22335 - RNA, 33 nt, synthetic construct
  misc_feature 1..33: note = derived and/or modified sequence opt2 from anti-influenza_CDR
  source 1..33: mol_type = other RNA
gccgcctgggacgactccctcaacggccagctc

SEQ ID NO: 22336 - RNA, 33 nt, synthetic construct
  misc_feature 1..33: note = derived and/or modified sequence opt2 from anti-influenza_CDR
  source 1..33: mol_type = other RNA
tgctcctacgccggctcctcctcctcccgcgtc

SEQ ID NO: 22337 - RNA, 33 nt, synthetic construct
  misc_feature 1..33: note = derived and/or modified sequence opt2 from anti-influenza_CDR
  source 1..33: mol_type = other RNA
ctcgtcctcgccaccggcctccgcaactccccc

SEQ ID NO: 22338 - RNA, 33 nt, synthetic construct
  misc_feature 1..33: note = derived and/or modified sequence opt2 from anti-influenza_CDR
  source 1..33: mol_type = other RNA
cagtccctcctccactccgacggcaagacctac

SEQ ID NO: 22339 - RNA, 33 nt, synthetic construct
  misc_feature 1..33: note = derived and/or modified sequence opt2 from anti-influenza_CDR
  source 1..33: mol_type = other RNA
cgcacctcccagtccctctcctcctacctccac

SEQ ID NO: 22340 - RNA, 33 nt, synthetic construct
  misc_feature 1..33: note = derived and/or modified sequence opt2 from anti-influenza_CDR
  source 1..33: mol_type = other RNA
cgcgcctcccagcgcctcaactcctacctccac

SEQ ID NO: 22341 - RNA, 33 nt, synthetic construct
  misc_feature 1..33: note = derived and/or modified sequence opt2 from anti-influenza_CDR
  source 1..33: mol_type = other RNA
cgcacctcccagtccctccgctcctacctccac

SEQ ID NO: 22342 - RNA, 33 nt, synthetic construct
  misc_feature 1..33: note = derived and/or modified sequence opt2 from anti-influenza_CDR
  source 1..33: mol_type = other RNA
cgcacctcccagtccctctcctcctacacccac

SEQ ID NO: 22343 - RNA, 33 nt, synthetic construct
  misc_feature 1..33: note = derived and/or modified sequence opt2 from anti-influenza_CDR
  source 1..33: mol_type = other RNA
cgcacctcccagtccctctcctcctacgaccac

SEQ ID NO: 22344 - RNA, 33 nt, synthetic construct
  misc_feature 1..33: note = derived and/or modified sequence opt2 from anti-influenza_CDR
  source 1..33: mol_type = other RNA
caggtctgggactcctcctccgaccactacgtc

SEQ ID NO: 22345 - RNA, 33 nt, synthetic construct
  misc_feature 1..33: note = derived and/or modified sequence opt2 from anti-influenza_CDR
  source 1..33: mol_type = other RNA
caggtctggggctcctcctccgaccactacgtc

SEQ ID NO: 22346 - RNA, 33 nt, synthetic construct
  misc_feature 1..33: note = derived and/or modified sequence opt2 from anti-influenza_CDR
  source 1..33: mol_type = other RNA
ggcacctgggactcctccctctccgtcggcatg

SEQ ID NO: 22347 - RNA, 33 nt, synthetic construct
  misc_feature 1..33: note = derived and/or modified sequence opt2 from anti-influenza_CDR
  source 1..33: mol_type = other RNA
cagtccctcctccacggcaacggctacaactac

SEQ ID NO: 22348 - RNA, 33 nt, synthetic construct
  misc_feature 1..33: note = derived and/or modified sequence opt2 from anti-influenza_CDR
  source 1..33: mol_type = other RNA
cgcgcctcccagggcatccgcaacgacctcggc

SEQ ID NO: 22349 - RNA, 33 nt, synthetic construct
  misc_feature 1..33: note = derived and/or modified sequence opt2 from anti-influenza_CDR
  source 1..33: mol_type = other RNA
cgcgcctcccagaacatccgctcctacctcaac

SEQ ID NO: 22350 - RNA, 33 nt, synthetic construct
  misc_feature 1..33: note = derived and/or modified sequence opt2 from anti-influenza_CDR
  source 1..33: mol_type = other RNA
cgcgccaaccaggacatcggcatctacctcaac

SEQ ID NO: 22351 - RNA, 33 nt, synthetic construct
  misc_feature 1..33: note = derived and/or modified sequence opt2 from anti-influenza_CDR
  source 1..33: mol_type = other RNA
cgcgcctcccagtccgtctccaacaacctcgcc

SEQ ID NO: 22352 - RNA, 33 nt, synthetic construct
  misc_feature 1..33: note = derived and/or modified sequence opt2 from anti-influenza_CDR
  source 1..33: mol_type = other RNA
cagcagtaccacaactggcccccctcctactcc

SEQ ID NO: 22353 - RNA, 33 nt, synthetic construct
  misc_feature 1..33: note = derived and/or modified sequence opt2 from anti-influenza_CDR
  source 1..33: mol_type = other RNA
cgcgcctcccagggcatcctcaactgcctcgcc

SEQ ID NO: 22354 - RNA, 33 nt, synthetic construct
  misc_feature 1..33: note = derived and/or modified sequence opt2 from anti-influenza_CDR
  source 1..33: mol_type = other RNA
cgcgcctcccagtccatcgcctcctggctcgcc

SEQ ID NO: 22355 - RNA, 33 nt, synthetic construct
  misc_feature 1..33: note = derived and/or modified sequence opt2 from anti-influenza_CDR
  source 1..33: mol_type = other RNA
gccccccgcgtctacgagtactacttcgaccag

SEQ ID NO: 22356 - RNA, 33 nt, synthetic construct
  misc_feature 1..33: note = derived and/or modified sequence opt2 from anti-influenza_CDR
  source 1..33: mol_type = other RNA
cgcgcctcccagtccgtctcctcctacctcgcc

SEQ ID NO: 22357 - RNA, 33 nt, synthetic construct
  misc_feature 1..33: note = derived and/or modified sequence opt2 from anti-influenza_CDR
  source 1..33: mol_type = other RNA
tccggcgacgccctccccaagcagaacgcctac

SEQ ID NO: 22358 - RNA, 33 nt, synthetic construct
  misc_feature 1..33: note = derived and/or modified sequence opt2 from anti-influenza_CDR
  source 1..33: mol_type = other RNA
cagtccgccgactcctccggcacctcctgggtc

SEQ ID NO: 22359 - RNA, 33 nt, synthetic construct
  misc_feature 1..33: note = derived and/or modified sequence opt2 from anti-influenza_CDR
  source 1..33: mol_type = other RNA
ggcggctccaacatcggcggcaagtccgtccac

SEQ ID NO: 22360 - RNA, 33 nt, synthetic construct
  misc_feature 1..33: note = derived and/or modified sequence opt2 from anti-influenza_CDR
  source 1..33: mol_type = other RNA
cagcactacggctcctccccccgctacgccttc

SEQ ID NO: 22361 - RNA, 33 nt, synthetic construct
  misc_feature 1..33: note = derived and/or modified sequence opt2 from anti-influenza_CDR
  source 1..33: mol_type = other RNA
cgcgcctcccagtccatctcctcctacctcaac

SEQ ID NO: 22362 - RNA, 33 nt, synthetic construct
  misc_feature 1..33: note = derived and/or modified sequence opt2 from anti-influenza_CDR
  source 1..33: mol_type = other RNA
ggcggcaacgccatcggctccaagaaggtccac

SEQ ID NO: 22363 - RNA, 33 nt, synthetic construct
  misc_feature 1..33: note = derived and/or modified sequence opt2 from anti-influenza_CDR
  source 1..33: mol_type = other RNA
caggtctgggacttcaccatcgaccacgtcgtc

SEQ ID NO: 22364 - RNA, 33 nt, synthetic construct
  misc_feature 1..33: note = derived and/or modified sequence opt2 from anti-influenza_CDR
  source 1..33: mol_type = other RNA
gccacctgggacggctccctctccgcctgggtc

SEQ ID NO: 22365 - RNA, 33 nt, synthetic construct
  misc_feature 1..33: note = derived and/or modified sequence opt2 from anti-influenza_CDR
  source 1..33: mol_type = other RNA
cgcgcctcccagtccgtcggcaactacctcgcc

SEQ ID NO: 22366 - RNA, 33 nt, synthetic construct
  misc_feature 1..33: note = derived and/or modified sequence opt2 from anti-influenza_CDR
  source 1..33: mol_type = other RNA
cagcagcgctccaagtggccccccatgtactcc

SEQ ID NO: 22367 - RNA, 33 nt, synthetic construct
  misc_feature 1..33: note = derived and/or modified sequence opt2 from anti-influenza_CDR
  source 1..33: mol_type = other RNA
gacgtctccaccacctggtcctggttcgccccc

SEQ ID NO: 22368 - RNA, 33 nt, synthetic construct
  misc_feature 1..33: note = derived and/or modified sequence opt2 from anti-influenza_CDR
  source 1..33: mol_type = other RNA
cgcgcctcccagaacatcaagcgctacttcaac

SEQ ID NO: 22369 - RNA, 33 nt, synthetic construct
  misc_feature 1..33: note = derived and/or modified sequence opt2 from anti-influenza_CDR
  source 1..33: mol_type = other RNA
cgcgcctcccagtccgtcggcaactccctcgcc

SEQ ID NO: 22370 - RNA, 33 nt, synthetic construct
  misc_feature 1..33: note = derived and/or modified sequence opt2 from anti-influenza_CDR
  source 1..33: mol_type = other RNA
ggcgagtccaccctctcctactacgccgtctcc

SEQ ID NO: 22371 - RNA, 33 nt, synthetic construct
  misc_feature 1..33: note = derived and/or modified sequence opt2 from anti-influenza_CDR
  source 1..33: mol_type = other RNA
cgcgcctcccagaacatctacaagtacctcaac

SEQ ID NO: 22372 - RNA, 33 nt, synthetic construct
  misc_feature 1..33: note = derived and/or modified sequence opt2 from anti-influenza_CDR
  source 1..33: mol_type = other RNA
gcctcctgctccggcggctactgcatcctcgac

SEQ ID NO: 22373 - RNA, 33 nt, synthetic construct
  misc_feature 1..33: note = derived and/or modified sequence opt2 from anti-influenza_CDR
  source 1..33: mol_type = other RNA
cgcacctcccagtccatctcctcctacctcaac

SEQ ID NO: 22374 - RNA, 33 nt, synthetic construct
  misc_feature 1..33: note = derived and/or modified sequence opt2 from anti-influenza_CDR
  source 1..33: mol_type = other RNA
cgcgcctcccagtccatcggcgcctacgtcaac

SEQ ID NO: 22375 - RNA, 33 nt, synthetic construct
  misc_feature 1..33: note = derived and/or modified sequence opt2 from anti-influenza_CDR
  source 1..33: mol_type = other RNA
cgcgcctcccagtccatctccacctacctcaac

SEQ ID NO: 22376 - RNA, 33 nt, synthetic construct
  misc_feature 1..33: note = derived and/or modified sequence opt2 from anti-influenza_CDR
  source 1..33: mol_type = other RNA
cgcgcctcccagtccatcgacaagttcctcaac

SEQ ID NO: 22377 - RNA, 33 nt, synthetic construct
  misc_feature 1..33: note = derived and/or modified sequence opt2 from anti-influenza_CDR
  source 1..33: mol_type = other RNA
ggcggccacaacatcggctccaactccgtccac

SEQ ID NO: 22378 - RNA, 33 nt, synthetic construct
  misc_feature 1..33: note = derived and/or modified sequence opt2 from anti-influenza_CDR
  source 1..33: mol_type = other RNA
cgcgcctcccagtccatctccacctacctccac

SEQ ID NO: 22379 - RNA, 33 nt, synthetic construct
  misc_feature 1..33: note = derived and/or modified sequence opt2 from anti-influenza_CDR
  source 1..33: mol_type = other RNA
cacgtcggcggccacacctacggcatcgactac

SEQ ID NO: 22380 - RNA, 33 nt, synthetic construct
  misc_feature 1..33: note = derived and/or modified sequence opt2 from anti-influenza_CDR
  source 1..33: mol_type = other RNA
cgcgcctcccagtccatctccaactacctcaac

SEQ ID NO: 22381 - RNA, 33 nt, synthetic construct
  misc_feature 1..33: note = derived and/or modified sequence opt2 from anti-influenza_CDR
  source 1..33: mol_type = other RNA
cacgacgacgcctcccacggctactccatctcc

SEQ ID NO: 22382 - RNA, 33 nt, synthetic construct
  misc_feature 1..33: note = derived and/or modified sequence opt2 from anti-influenza_CDR
  source 1..33: mol_type = other RNA
cgcgcctcccagaccatctccacctacctcaac

SEQ ID NO: 22383 - RNA, 33 nt, synthetic construct
  misc_feature 1..33: note = derived and/or modified sequence opt2 from anti-influenza_CDR
  source 1..33: mol_type = other RNA
cgcgcctcccagtccatctcccgctacctcaac

SEQ ID NO: 22384 - RNA, 33 nt, synthetic construct
  misc_feature 1..33: note = derived and/or modified sequence opt2 from anti-influenza_CDR
  source 1..33: mol_type = other RNA
ggcacctgggactcctccctctccgcctacgtc

SEQ ID NO: 22385 - RNA, 33 nt, synthetic construct
  misc_feature 1..33: note = derived and/or modified sequence opt2 from anti-influenza_CDR
  source 1..33: mol_type = other RNA
tcctccaactactacgactccgtctacgactac

SEQ ID NO: 22386 - RNA, 33 nt, synthetic construct
  misc_feature 1..33: note = derived and/or modified sequence opt2 from anti-influenza_CDR
  source 1..33: mol_type = other RNA
gccgcctgggacgacatcctcaacgtccccgtc

SEQ ID NO: 22387 - RNA, 33 nt, synthetic construct
  misc_feature 1..33: note = derived and/or modified sequence opt2 from anti-influenza_CDR
  source 1..33: mol_type = other RNA
gtcgcctgggacgactccgtcgacggctacgtc

SEQ ID NO: 22388 - RNA, 33 nt, synthetic construct
  misc_feature 1..33: note = derived and/or modified sequence opt2 from anti-influenza_CDR
  source 1..33: mol_type = other RNA
ggccccaagtactactccgagtacatggacgtc

SEQ ID NO: 22389 - RNA, 33 nt, synthetic construct
  misc_feature 1..33: note = derived and/or modified sequence opt2 from anti-influenza_CDR
  source 1..33: mol_type = other RNA
cgcgcctcccagggcatctcctcctacctcgcc

SEQ ID NO: 22390 - RNA, 33 nt, synthetic construct
  misc_feature 1..33: note = derived and/or modified sequence opt2 from anti-influenza_CDR
  source 1..33: mol_type = other RNA
tcctccggctactaccccgagtacttccaggac

SEQ ID NO: 22391 - RNA, 33 nt, synthetic construct
  misc_feature 1..33: note = derived and/or modified sequence opt2 from anti-influenza_CDR
  source 1..33: mol_type = other RNA
tccggccacaagctcggcgacaagtacgtctcc

SEQ ID NO: 22392 - RNA, 33 nt, synthetic construct
  misc_feature 1..33: note = derived and/or modified sequence opt2 from anti-influenza_CDR
  source 1..33: mol_type = other RNA
tccaccggctactaccccgcctacctccaccac

SEQ ID NO: 22393 - RNA, 33 nt, synthetic construct
  misc_feature 1..33: note = derived and/or modified sequence opt2 from anti-influenza_CDR
  source 1..33: mol_type = other RNA
cgcgcctcccagcgcgtctcctcctacctcgcc

SEQ ID NO: 22394 - RNA, 33 nt, synthetic construct; identical to SEQ ID NO: 21287
  misc_feature 1..33: note = derived and/or modified sequence opt2 from anti-influenza_CDR
  source 1..33: mol_type = other RNA

SEQ ID NO: 22395 - RNA, 33 nt, synthetic construct
  misc_feature 1..33: note = derived and/or modified sequence opt2 from anti-influenza_CDR
  source 1..33: mol_type = other RNA
caggtctgggactcctcctccgaccacgccgtc

SEQ ID NO: 22396 - RNA, 33 nt, synthetic construct
  misc_feature 1..33: note = derived and/or modified sequence opt2 from anti-influenza_CDR
  source 1..33: mol_type = other RNA
gccacctgggacgacaacctctccggccccgtc

SEQ ID NO: 22397 - RNA, 33 nt, synthetic construct
  misc_feature 1..33: note = derived and/or modified sequence opt2 from anti-influenza_CDR
  source 1..33: mol_type = other RNA
tcctccggctactaccccgcctacctcccccac

SEQ ID NO: 22398 - RNA, 33 nt, synthetic construct
  misc_feature 1..33: note = derived and/or modified sequence opt2 from anti-influenza_CDR
  source 1..33: mol_type = other RNA
ggcggcaacaacatcggctccaagggcgtccac

SEQ ID NO: 22399 - RNA, 33 nt, synthetic construct
  misc_feature 1..33: note = derived and/or modified sequence opt2 from anti-influenza_CDR
  source 1..33: mol_type = other RNA
caggtctgggactcctcctccgaccacgtcgtc

SEQ ID NO: 22400 - RNA, 33 nt, synthetic construct
  misc_feature 1..33: note = derived and/or modified sequence opt2 from anti-influenza_CDR
  source 1..33: mol_type = other RNA
ggcaactactactacgagtcctccctcgactac

SEQ ID NO: 22401 - RNA, 33 nt, synthetic construct
  misc_feature 1..33: note = derived and/or modified sequence opt2 from anti-influenza_CDR
  source 1..33: mol_type = other RNA
ggcccccactactactcctcctacatggacgtc

SEQ ID NO: 22402 - RNA, 33 nt, synthetic construct
  misc_feature 1..33: note = derived and/or modified sequence opt2 from anti-influenza_CDR
  source 1..33: mol_type = other RNA
cgcgcctcccagggcatctccacctacctcgcc

SEQ ID NO: 22403 - RNA, 33 nt, synthetic construct
  misc_feature 1..33: note = derived and/or modified sequence opt2 from anti-influenza_CDR
  source 1..33: mol_type = other RNA
ggccccacctactactactcctacatggacgtc

SEQ ID NO: 22404 - RNA, 33 nt, synthetic construct
  misc_feature 1..33: note = derived and/or modified sequence opt2 from anti-influenza_CDR
  source 1..33: mol_type = other RNA
ggcggcaacaacatcggccgcaactccgtccac

SEQ ID NO: 22405 - RNA, 33 nt, synthetic construct
  misc_feature 1..33: note = derived and/or modified sequence opt2 from anti-influenza_CDR
  source 1..33: mol_type = other RNA
caggtctggcactcctcctccgaccactacgtc

SEQ ID NO: 22406 - RNA, 33 nt, synthetic construct
  misc_feature 1..33: note = derived and/or modified sequence opt2 from anti-influenza_CDR
  source 1..33: mol_type = other RNA
tcctccggctactacccccagtacttccaggac

SEQ ID NO: 22407 - RNA, 33 nt, synthetic construct
  misc_feature 1..33: note = derived and/or modified sequence opt2 from anti-influenza_CDR
  source 1..33: mol_type = other RNA
cgcgcctcccagtccgtctcccgctacctcgcc

SEQ ID NO: 22408 - RNA, 33 nt, synthetic construct
  misc_feature 1..33: note = derived and/or modified sequence opt2 from anti-influenza_CDR
  source 1..33: mol_type = other RNA
tggggccagggcaccaccctcaccgtctcctcc

SEQ ID NO: 22409 - RNA, 33 nt, synthetic construct
  misc_feature 1..33: note = derived and/or modified sequence opt2 from anti-influenza_CDR
  source 1..33: mol_type = other RNA
cgcgcctcccagtccgtcgactccaacctcgcc

SEQ ID NO: 22410 - RNA, 33 nt, synthetic construct
  misc_feature 1..33: note = derived and/or modified sequence opt2 from anti-influenza_CDR
  source 1..33: mol_type = other RNA
cgcgcctcccagtccgtctcccacaacctcgcc

SEQ ID NO: 22411 - RNA, 33 nt, synthetic construct
  misc_feature 1..33: note = derived and/or modified sequence opt2 from anti-influenza_CDR
  source 1..33: mol_type = other RNA
cgcgcctcccagtccgtctcctccaacctcgcc

SEQ ID NO: 22412 - RNA, 33 nt, synthetic construct
  misc_feature 1..33: note = derived and/or modified sequence opt2 from anti-influenza_CDR
  source 1..33: mol_type = other RNA
cgcgcctcccagtccgtcgaccacaacctcgcc

SEQ ID NO: 22413 - RNA, 33 nt, synthetic construct
  misc_feature 1..33: note = derived and/or modified sequence opt2 from anti-influenza_CDR
  source 1..33: mol_type = other RNA
cagcactacaccaactggcccccccgcctcacc

SEQ ID NO: 22414 - RNA, 33 nt, synthetic construct
  misc_feature 1..33: note = derived and/or modified sequence opt2 from anti-influenza_CDR
  source 1..33: mol_type = other RNA
cagcactacaccaactaccccccccgcctcacc

SEQ ID NO: 22415 - RNA, 33 nt, synthetic construct
  misc_feature 1..33: note = derived and/or modified sequence opt2 from anti-influenza_CDR
  source 1..33: mol_type = other RNA
cagcactacaccaacttccccccccgcctcacc

SEQ ID NO: 22416 - RNA, 33 nt, synthetic construct
  misc_feature 1..33: note = derived and/or modified sequence opt2 from anti-influenza_CDR
  source 1..33: mol_type = other RNA
cgcgcctcccaggtcatctcccacaacctcgcc

SEQ ID NO: 22417 - RNA, 33 nt, synthetic construct
  misc_feature 1..33: note = derived and/or modified sequence opt2 from anti-influenza_CDR
  source 1..33: mol_type = other RNA
cagcactactccaactggcccccccgcctcacc

SEQ ID NO: 22418 - RNA, 33 nt, synthetic construct
  misc_feature 1..33: note = derived and/or modified sequence opt2 from anti-influenza_CDR
  source 1..33: mol_type = other RNA
cagcactactccaacttccccccccgcctcacc

SEQ ID NO: 22419 - RNA, 33 nt, synthetic construct
  misc_feature 1..33: note = derived and/or modified sequence opt2 from anti-influenza_CDR
  source 1..33: mol_type = other RNA
cagcactactccaactaccccccccgcctcacc

SEQ ID NO: 22420 - RNA, 33 nt, synthetic construct
  misc_feature 1..33: note = derived and/or modified sequence opt2 from anti-influenza_CDR
  source 1..33: mol_type = other RNA
cgcgcctcccagtccgtcgccaacaacctcgcc

SEQ ID NO: 22421 - RNA, 33 nt, synthetic construct
  misc_feature 1..33: note = derived and/or modified sequence opt2 from anti-influenza_CDR
  source 1..33: mol_type = other RNA
cagcagtacaacaactggccccccatgtacacc

SEQ ID NO: 22422 - RNA, 33 nt, synthetic construct
  misc_feature 1..33: note = derived and/or modified sequence opt2 from anti-influenza_CDR
  source 1..33: mol_type = other RNA
cgcgcctcccagtccatcggcaactggctcgcc

SEQ ID NO: 22423 - RNA, 33 nt, synthetic construct
  misc_feature 1..33: note = derived and/or modified sequence opt2 from anti-influenza_CDR
  source 1..33: mol_type = other RNA
cagcgctacacctccaactcccagggcttcacc

SEQ ID NO: 22424 - RNA, 33 nt, synthetic construct
  misc_feature 1..33: note = derived and/or modified sequence opt2 from anti-influenza_CDR
  source 1..33: mol_type = other RNA
gccgcctgggacgacaccctcaacggccccgtc

SEQ ID NO: 22425 - RNA, 33 nt, synthetic construct
  misc_feature 1..33: note = derived and/or modified sequence opt2 from anti-influenza_CDR
  source 1..33: mol_type = other RNA
aaggcctcccagaacgtcggctccaacgtcgcc

SEQ ID NO: 22426 - RNA, 33 nt, synthetic construct
  misc_feature 1..33: note = derived and/or modified sequence opt2 from anti-influenza_CDR
  source 1..33: mol_type = other RNA
caggtctgggacatgtcctccgaccgccgcgtc

SEQ ID NO: 22427 - RNA, 33 nt, synthetic construct
  misc_feature 1..33: note = derived and/or modified sequence opt2 from anti-influenza_CDR
  source 1..33: mol_type = other RNA
cagtccctcctccactccaacggctacaactac

SEQ ID NO: 22428 - RNA, 33 nt, synthetic construct
  misc_feature 1..33: note = derived and/or modified sequence opt2 from anti-influenza_CDR
  source 1..33: mol_type = other RNA
acctacctcgtcggcgccgtcggcttccagcac

SEQ ID NO: 22429 - RNA, 33 nt, synthetic construct; identical to SEQ ID NO: 21340
  misc_feature 1..33: note = derived and/or modified sequence opt2 from anti-influenza_CDR
  source 1..33: mol_type = other RNA

SEQ ID NO: 22430 - RNA, 33 nt, synthetic construct
  misc_feature 1..33: note = derived and/or modified sequence opt2 from anti-influenza_CDR
  source 1..33: mol_type = other RNA
cagtccctcctcgactccaacggctacaactac

SEQ ID NO: 22431 - RNA, 33 nt, synthetic construct
  misc_feature 1..33: note = derived and/or modified sequence opt2 from anti-influenza_CDR
  source 1..33: mol_type = other RNA
atgcaggccctccagaccccccccatgtacacc

SEQ ID NO: 22432 - RNA, 33 nt, synthetic construct
  misc_feature 1..33: note = derived and/or modified sequence opt2 from anti-influenza_CDR
  source 1..33: mol_type = other RNA
cagtccctcctccactccaacggctacaaccac

SEQ ID NO: 22433 - RNA, 33 nt, synthetic construct
  misc_feature 1..33: note = derived and/or modified sequence opt2 from anti-influenza_CDR
  source 1..33: mol_type = other RNA
caggtctgggacatcacctccgacctcgtcgtc

SEQ ID NO: 22434 - RNA, 33 nt, synthetic construct
  misc_feature 1..33: note = derived and/or modified sequence opt2 from anti-influenza_CDR
  source 1..33: mol_type = other RNA
cgcgcctcccaggacatctccacctggctcgcc

SEQ ID NO: 22435 - RNA, 33 nt, synthetic construct
  misc_feature 1..33: note = derived and/or modified sequence opt2 from anti-influenza_CDR
  source 1..33: mol_type = other RNA
cgcgcctcccgctccatcaccaccttcctcgcc

SEQ ID NO: 22436 - RNA, 33 nt, synthetic construct
  misc_feature 1..33: note = derived and/or modified sequence opt2 from anti-influenza_CDR
  source 1..33: mol_type = other RNA
ggctggggcgccgtcacctcccccttcgacttc

SEQ ID NO: 22437 - RNA, 33 nt, synthetic construct
  misc_feature 1..33: note = derived and/or modified sequence opt2 from anti-influenza_CDR
  source 1..33: mol_type = other RNA
cgcgcctcccagtccgtctcctcctcctacctc

SEQ ID NO: 22438 - RNA, 36 nt, synthetic construct
  misc_feature 1..36: note = derived and/or modified sequence opt2 from anti-influenza_CDR
  source 1..36: mol_type = other RNA
cagtccgtcctctactcctccaacaacaagaactac

SEQ ID NO: 22439 - RNA, 36 nt, synthetic construct
  misc_feature 1..36: note = derived and/or modified sequence opt2 from anti-influenza_CDR
  source 1..36: mol_type = other RNA
gccgcctgggacgactccctctccggctcctgggtc

SEQ ID NO: 22440 - RNA, 36 nt, synthetic construct
  misc_feature 1..36: note = derived and/or modified sequence opt2 from anti-influenza_CDR
  source 1..36: mol_type = other RNA
gtcttctactccgccgaccgcacctcctacgccgac

SEQ ID NO: 22441 - RNA, 36 nt, synthetic construct
  misc_feature 1..36: note = derived and/or modified sequence opt2 from anti-influenza_CDR
  source 1..36: mol_type = other RNA
cgcgtcggccagtccgtctccggctcccacctcgcc

SEQ ID NO: 22442 - RNA, 36 nt, synthetic construct
  misc_feature 1..36: note = derived and/or modified sequence opt2 from anti-influenza_CDR
  source 1..36: mol_type = other RNA
accctctcctccgcctactccaactacaaggtcgac

SEQ ID NO: 22443 - RNA, 36 nt, synthetic construct
  misc_feature 1..36: note = derived and/or modified sequence opt2 from anti-influenza_CDR
  source 1..36: mol_type = other RNA
gtcggcaccggcggcatcgtcggctccaagggcgac

SEQ ID NO: 22444 - RNA, 36 nt, synthetic construct
  misc_feature 1..36: note = derived and/or modified sequence opt2 from anti-influenza_CDR
  source 1..36: mol_type = other RNA
cgctactcccgctcctcccccggcaccttcgagtcc

SEQ ID NO: 22445 - RNA, 36 nt, synthetic construct
  misc_feature 1..36: note = derived and/or modified sequence opt2 from anti-influenza_CDR
  source 1..36: mol_type = other RNA
cagtcctacgactcctccctctccggcttccacgtc

SEQ ID NO: 22446 - RNA, 36 nt, synthetic construct
  misc_feature 1..36: note = derived and/or modified sequence opt2 from anti-influenza_CDR
  source 1..36: mol_type = other RNA
cgcgcctcccagtccgtctcctcctcccagctcgcc

SEQ ID NO: 22447 - RNA, 36 nt, synthetic construct
  misc_feature 1..36: note = derived and/or modified sequence opt2 from anti-influenza_CDR
  source 1..36: mol_type = other RNA
cgcgcctcccagttcgtctccacccgctccctcgcc

SEQ ID NO: 22448 - RNA, 36 nt, synthetic construct
  misc_feature 1..36: note = derived and/or modified sequence opt2 from anti-influenza_CDR
  source 1..36: mol_type = other RNA
gccacctgggacgactccctcaacggcttctacgtc

SEQ ID NO: 22449 - RNA, 36 nt, synthetic construct
  misc_feature 1..36: note = derived and/or modified sequence opt2 from anti-influenza_CDR
  source 1..36: mol_type = other RNA
cgcgcctcccacttcgtcaactaccgctccctcgcc

SEQ ID NO: 22450 - RNA, 36 nt, synthetic construct
  misc_feature 1..36: note = derived and/or modified sequence opt2 from anti-influenza_CDR
  source 1..36: mol_type = other RNA
cgcgcctcccacttcgtcatcggccgcgccgtcgcc

SEQ ID NO: 22451 - RNA, 36 nt, synthetic construct
  misc_feature 1..36: note = derived and/or modified sequence opt2 from anti-influenza_CDR
  source 1..36: mol_type = other RNA
cgcatctaccacggcggcaactccggcttcgacttc

SEQ ID NO: 22452 - RNA, 36 nt, synthetic construct
  misc_feature 1..36: note = derived and/or modified sequence opt2 from anti-influenza_CDR
  source 1..36: mol_type = other RNA
accctctcctccggcttcgacaactaccaggtcgcc

SEQ ID NO: 22453 - RNA, 36 nt, synthetic construct
  misc_feature 1..36: note = derived and/or modified sequence opt2 from anti-influenza_CDR
  source 1..36: mol_type = other RNA
gtcggcaacggcggcaacgtcgcctccaagggcgac

SEQ ID NO: 22454 - RNA, 36 nt, synthetic construct
  misc_feature 1..36: note = derived and/or modified sequence opt2 from anti-influenza_CDR
  source 1..36: mol_type = other RNA
gtccgcggcggctccaccgtcgcctacttcggcgtc

SEQ ID NO: 22455 - RNA, 36 nt, synthetic construct
  misc_feature 1..36: note = derived and/or modified sequence opt2 from anti-influenza_CDR
  source 1..36: mol_type = other RNA
tgcctctcccgcatgcgcggctacggcctcgacgtc

SEQ ID NO: 22456 - RNA, 36 nt, synthetic construct
  misc_feature 1..36: note = derived and/or modified sequence opt2 from anti-influenza_CDR
  source 1..36: mol_type = other RNA
gtcggccagatggacaagtactacgccatggacgtc

SEQ ID NO: 22457 - RNA, 36 nt, synthetic construct
  misc_feature 1..36: note = derived and/or modified sequence opt2 from anti-influenza_CDR
  source 1..36: mol_type = other RNA
ggcgtcaccaacaaggtcaactccatcatcgacaag

SEQ ID NO: 22458 - RNA, 36 nt, synthetic construct
  misc_feature 1..36: note = derived and/or modified sequence opt2 from anti-influenza_CDR
  source 1..36: mol_type = other RNA
ggcgtcaccaacaaggtcaaccgcatcatcgacaag

SEQ ID NO: 22459 - RNA, 36 nt, synthetic construct
  misc_feature 1..36: note = derived and/or modified sequence opt2 from anti-influenza_CDR
  source 1..36: mol_type = other RNA
ggcgtcaccaacaaggagaactccatcatcgacaag

SEQ ID NO: 22460 - RNA, 36 nt, synthetic construct
  misc_feature 1..36: note = derived and/or modified sequence opt2 from anti-influenza_CDR
  source 1..36: mol_type = other RNA
cccctcggcatcctccactactacgccatggacctc

SEQ ID NO: 22461 - RNA, 36 nt, synthetic construct
  misc_feature 1..36: note = derived and/or modified sequence opt2 from anti-influenza_CDR
  source 1..36: mol_type = other RNA
aagatcacctccaaggtcaacaacatcgtcgacaag

SEQ ID NO: 22462 - RNA, 36 nt, synthetic construct
  misc_feature 1..36: note = derived and/or modified sequence opt2 from anti-influenza_CDR
  source 1..36: mol_type = other RNA
ggcatcaccaacaaggtcaactccatcatcgacaag

SEQ ID NO: 22463 - RNA, 36 nt, synthetic construct
  misc_feature 1..36: note = derived and/or modified sequence opt2 from anti-influenza_CDR
  source 1..36: mol_type = other RNA
aacggccgctcctccacctcctggggcatcgacgtc

SEQ ID NO: 22464 - RNA, 36 nt, synthetic construct
  misc_feature 1..36: note = derived and/or modified sequence opt2 from anti-influenza_CDR
  source 1..36: mol_type = other RNA
ggcatcaccaacaaggagaactccgtcatcgagaag

SEQ ID NO: 22465 - RNA, 36 nt, synthetic construct
  misc_feature 1..36: note = derived and/or modified sequence opt2 from anti-influenza_CDR
  source 1..36: mol_type = other RNA
cccctcggctcccgctactactacggcatggacgtc

SEQ ID NO: 22466 - RNA, 36 nt, synthetic construct
  misc_feature 1..36: note = derived and/or modified sequence opt2 from anti-influenza_CDR
  source 1..36: mol_type = other RNA
ggcatcaccaacaaggtcaactccgtcatcgagaag

SEQ ID NO: 22467 - RNA, 36 nt, synthetic construct
  misc_feature 1..36: note = derived and/or modified sequence opt2 from anti-influenza_CDR
  source 1..36: mol_type = other RNA
ggcgtcaccaacaaggtcaactccatcatcaacaag

SEQ ID NO: 22468 - RNA, 36 nt, synthetic construct
  misc_feature 1..36: note = derived and/or modified sequence opt2 from anti-influenza_CDR
  source 1..36: mol_type = other RNA
cacatgggctaccaggtccgcgagaccatggacgtc

SEQ ID NO: 22469 - RNA, 36 nt, synthetic construct
  misc_feature 1..36: note = derived and/or modified sequence opt2 from anti-influenza_CDR
  source 1..36: mol_type = other RNA
gccacctgggaccgccgccccaccgcctacgtcgtc

SEQ ID NO: 22470 - RNA, 36 nt, synthetic construct
  misc_feature 1..36: note = derived and/or modified sequence opt2 from anti-influenza_CDR
  source 1..36: mol_type = other RNA
gagggcaagtggggcccccaggccgccttcgacatc

SEQ ID NO: 22471 - RNA, 36 nt, synthetic construct
  misc_feature 1..36: note = derived and/or modified sequence opt2 from anti-influenza_CDR
  source 1..36: mol_type = other RNA
ggcgacaagggcatctactactactacatggacgtc

SEQ ID NO: 22472 - RNA, 36 nt, synthetic construct
  misc_feature 1..36: note = derived and/or modified sequence opt2 from anti-influenza_CDR
  source 1..36: mol_type = other RNA
ggctccggctaccacatctccacccccttcgacaac

SEQ ID NO: 22473 - RNA, 36 nt, synthetic construct
  misc_feature 1..36: note = derived and/or modified sequence opt2 from anti-influenza_CDR
  source 1..36: mol_type = other RNA
cgcgcctcccagtccgtctcctcctcctacctcgcc

SEQ ID NO: 22474 - RNA, 36 nt, synthetic construct
  misc_feature 1..36: note = derived and/or modified sequence opt2 from anti-influenza_CDR
  source 1..36: mol_type = other RNA
ggctccggctacaccacccgcaactacttcgactac

SEQ ID NO: 22475 - RNA, 36 nt, synthetic construct
  misc_feature 1..36: note = derived and/or modified sequence opt2 from anti-influenza_CDR
  source 1..36: mol_type = other RNA
cgcgcctcccagtccgtctcctccaactacctcggc

SEQ ID NO: 22476 - RNA, 36 nt, synthetic construct
  misc_feature 1..36: note = derived and/or modified sequence opt2 from anti-influenza_CDR
  source 1..36: mol_type = other RNA
ggctccacctacgacttctcctccggcctcgactac

SEQ ID NO: 22477 - RNA, 36 nt, synthetic construct
  misc_feature 1..36: note = derived and/or modified sequence opt2 from anti-influenza_CDR
  source 1..36: mol_type = other RNA
ggcgtccaccaccccggcaccgacaacgaccagatc

SEQ ID NO: 22478 - RNA, 36 nt, synthetic construct
  misc_feature 1..36: note = derived and/or modified sequence opt2 from anti-influenza_CDR
  source 1..36: mol_type = other RNA
ggcgtccaccacccctccaccgactccgaccagacc

SEQ ID NO: 22479 - RNA, 36 nt, synthetic construct
  misc_feature 1..36: note = derived and/or modified sequence opt2 from anti-influenza_CDR
  source 1..36: mol_type = other RNA
ggcgtccaccacccctccaacgagaccgagcagcgc

SEQ ID NO: 22480 - RNA, 36 nt, synthetic construct
  misc_feature 1..36: note = derived and/or modified sequence opt2 from anti-influenza_CDR
  source 1..36: mol_type = other RNA
cagtccatcaccttcgactacaagaactacctcgcc

SEQ ID NO: 22481 - RNA, 36 nt, synthetic construct
  misc_feature 1..36: note = derived and/or modified sequence opt2 from anti-influenza_CDR
  source 1..36: mol_type = other RNA
ggcggcctcatcggcaccggctcctactactggggc

SEQ ID NO: 22482 - RNA, 36 nt, synthetic construct
  misc_feature 1..36: note = derived and/or modified sequence opt2 from anti-influenza_CDR
  source 1..36: mol_type = other RNA
gcccgctacaactggggcatccgctacttcgacttc

SEQ ID NO: 22483 - RNA, 36 nt, synthetic construct
  misc_feature 1..36: note = derived and/or modified sequence opt2 from anti-influenza_CDR
  source 1..36: mol_type = other RNA
cagtccgtcctctccaactccaagaacctcaactac

SEQ ID NO: 22484 - RNA, 36 nt, synthetic construct
  misc_feature 1..36: note = derived and/or modified sequence opt2 from anti-influenza_CDR
  source 1..36: mol_type = other RNA
tgccaggtctgggagacctccgaggacctctgggtc

SEQ ID NO: 22485 - RNA, 39 nt, synthetic construct
  misc_feature 1..39: note = derived and/or modified sequence opt2 from anti-influenza_CDR
  source 1..39: mol_type = other RNA
gcccgcggcggccgctactacgtcgactacttcgactac

SEQ ID NO: 22486 - RNA, 39 nt, synthetic construct
  misc_feature 1..39: note = derived and/or modified sequence opt2 from anti-influenza_CDR
  source 1..39: mol_type = other RNA
gcccgctccggcgacggctacaactactacttccccctc

SEQ ID NO: 22487 - RNA, 39 nt, synthetic construct
  misc_feature 1..39: note = derived and/or modified sequence opt2 from anti-influenza_CDR
  source 1..39: mol_type = other RNA
gcccgcggctgcggctacaactgctactacttcgacggc

SEQ ID NO: 22488 - RNA, 39 nt, synthetic construct
  misc_feature 1..39: note = derived and/or modified sequence opt2 from anti-influenza_CDR
  source 1..39: mol_type = other RNA
tccggctcctcctccaacatcggctccaacaccgtcaac

SEQ ID NO: 22489 - RNA, 39 nt, synthetic construct
  misc_feature 1..39: note = derived and/or modified sequence opt2 from anti-influenza_CDR
  source 1..39: mol_type = other RNA
gactccccctactcctcctcctggtccttcttcgactac

SEQ ID NO: 22490 - RNA, 39 nt, synthetic construct
  misc_feature 1..39: note = derived and/or modified sequence opt2 from anti-influenza_CDR
  source 1..39: mol_type = other RNA
tccggctccgactccaacatcggcgactacttcgtctgc

SEQ ID NO: 22491 - RNA, 39 nt, synthetic construct
  misc_feature 1..39: note = derived and/or modified sequence opt2 from anti-influenza_CDR
  source 1..39: mol_type = other RNA
gcccgcatggtcgtcgtcaccggcgacggcttcgacgtc

SEQ ID NO: 22492 - RNA, 39 nt, synthetic construct
  misc_feature 1..39: note = derived and/or modified sequence opt2 from anti-influenza_CDR
  source 1..39: mol_type = other RNA
tggctctccatcatcaacgccggcggcggcgacatcgac

SEQ ID NO: 22493 - RNA, 39 nt, synthetic construct
  misc_feature 1..39: note = derived and/or modified sequence opt2 from anti-influenza_CDR
  source 1..39: mol_type = other RNA
gccgcctcctccctccagtccggcgtcccctcccgcttc

SEQ ID NO: 22494 - RNA, 39 nt, synthetic construct
  misc_feature 1..39: note = derived and/or modified sequence opt2 from anti-influenza_CDR
  source 1..39: mol_type = other RNA
cacgacgccaagttctccggctcctactacgtcgcctcc

SEQ ID NO: 22495 - RNA, 39 nt, synthetic construct
  misc_feature 1..39: note = derived and/or modified sequence opt2 from anti-influenza_CDR
  source 1..39: mol_type = other RNA
cacgacgtcaagttctccggctcctactacgtcgcctcc

SEQ ID NO: 22496 - RNA, 39 nt, synthetic construct
  misc_feature 1..39: note = derived and/or modified sequence opt2 from anti-influenza_CDR
  source 1..39: mol_type = other RNA
accggctccgagtccaccaccggctacggcatggacgtc

SEQ ID NO: 22497 - RNA, 39 nt, synthetic construct
  misc_feature 1..39: note = derived and/or modified sequence opt2 from anti-influenza_CDR
  source 1..39: mol_type = other RNA
gccgcctccacctccgtcctcggctacggcatggacgtc

SEQ ID NO: 22498 - RNA, 39 nt, synthetic construct
  misc_feature 1..39: note = derived and/or modified sequence opt2 from anti-influenza_CDR
  source 1..39: mol_type = other RNA
tccggctccaccttcaacatcggctccaacgccgtcgac

SEQ ID NO: 22499 - RNA, 39 nt, synthetic construct
  misc_feature 1..39: note = derived and/or modified sequence opt2 from anti-influenza_CDR
  source 1..39: mol_type = other RNA
tccggctcccgctccaacgtcggcgacaactccgtctac

SEQ ID NO: 22500 - RNA, 39 nt, synthetic construct
  misc_feature 1..39: note = derived and/or modified sequence opt2 from anti-influenza_CDR
  source 1..39: mol_type = other RNA
tccggctcctcctccaacatcggcaacgactacgtctcc

SEQ ID NO: 22501 - RNA, 39 nt, synthetic construct
  misc_feature 1..39: note = derived and/or modified sequence opt2 from anti-influenza_CDR
  source 1..39: mol_type = other RNA
ggcggcggctcctacggcgcctacgagggcttcgactac

SEQ ID NO: 22502 - RNA, 39 nt, synthetic construct
  misc_feature 1..39: note = derived and/or modified sequence opt2 from anti-influenza_CDR
  source 1..39: mol_type = other RNA
tccggctcctcctccaacatcggctccaactacgtctac

SEQ ID NO: 22503 - RNA, 39 nt, synthetic construct
  misc_feature 1..39: note = derived and/or modified sequence opt2 from anti-influenza_CDR
  source 1..39: mol_type = other RNA
gcccgccgccagcagctctacaagggctactaccaccac

SEQ ID NO: 22504 - RNA, 39 nt, synthetic construct
  misc_feature 1..39: note = derived and/or modified sequence opt2 from anti-influenza_CDR
  source 1..39: mol_type = other RNA
tccggctccacctccaacatcggctacaaccccgtctcc

SEQ ID NO: 22505 - RNA, 39 nt, synthetic construct
  misc_feature 1..39: note = derived and/or modified sequence opt2 from anti-influenza_CDR
  source 1..39: mol_type = other RNA
gcccgcggcatgaactactactccgactacttcgactac

SEQ ID NO: 22506 - RNA, 39 nt, synthetic construct
  misc_feature 1..39: note = derived and/or modified sequence opt2 from anti-influenza_CDR
  source 1..39: mol_type = other RNA
gcccgcggccactccggctcctaccgcctcttcgacttc

SEQ ID NO: 22507 - RNA, 39 nt, synthetic construct
  misc_feature 1..39: note = derived and/or modified sequence opt2 from anti-influenza_CDR
  source 1..39: mol_type = other RNA
gccaagcccctccgcggctcctaccgctacttcgacctc

SEQ ID NO: 22508 - RNA, 39 nt, synthetic construct
  misc_feature 1..39: note = derived and/or modified sequence opt2 from anti-influenza_CDR
  source 1..39: mol_type = other RNA
cccatctgggtcaagacccccctcaagctcgccaacggc

SEQ ID NO: 22509 - RNA, 39 nt, synthetic construct
  misc_feature 1..39: note = derived and/or modified sequence opt2 from anti-influenza_CDR
  source 1..39: mol_type = other RNA
caggcctcccagtccgtctacaacaagaacaacctcgcc

SEQ ID NO: 22510 - RNA, 39 nt, synthetic construct
  misc_feature 1..39: note = derived and/or modified sequence opt2 from anti-influenza_CDR
  source 1..39: mol_type = other RNA
cagtcctccgagtccgtctacaagaacaacaacctcgcc

SEQ ID NO: 22511 - RNA, 39 nt, synthetic construct
  misc_feature 1..39: note = derived and/or modified sequence opt2 from anti-influenza_CDR
  source 1..39: mol_type = other RNA
cagtcctcccagtccgtcgactccaacaaccagctctcc

SEQ ID NO: 22512 - RNA, 39 nt, synthetic construct
  misc_feature 1..39: note = derived and/or modified sequence opt2 from anti-influenza_CDR
  source 1..39: mol_type = other RNA
cagtcctcccagtccgtcgacaacaacaaggacctcgcc

SEQ ID NO: 22513 - RNA, 39 nt, synthetic construct
  misc_feature 1..39: note = derived and/or modified sequence opt2 from anti-influenza_CDR
  source 1..39: mol_type = other RNA
cagtcctcccagtccgtctacaacaacaaccgcctctcc

SEQ ID NO: 22514 - RNA, 39 nt, synthetic construct
  misc_feature 1..39: note = derived and/or modified sequence opt2 from anti-influenza_CDR
  source 1..39: mol_type = other RNA
cagtcctcccagtccgtctacaagaacaacaacctcgcc

SEQ ID NO: 22515 - RNA, 39 nt, synthetic construct
  misc_feature 1..39: note = derived and/or modified sequence opt2 from anti-influenza_CDR
  source 1..39: mol_type = other RNA
ggcggcggcttcggctggtcccagacctacttcggctac

SEQ ID NO: 22516 - RNA, 42 nt, synthetic construct
  misc_feature 1..42: note = derived and/or modified sequence opt2 from anti-influenza_CDR
  source 1..42: mol_type = other RNA
tggctcggccgcacctactaccgctccaagtggtacaacgac

SEQ ID NO: 22517 - RNA, 42 nt, synthetic construct
  misc_feature 1..42: note = derived and/or modified sequence opt2 from anti-influenza_CDR
  source 1..42: mol_type = other RNA
ggcggcctcgtcggcggctacgacgagtacttcttcgactac

SEQ ID NO: 22518 - RNA, 42 nt, synthetic construct
  misc_feature 1..42: note = derived and/or modified sequence opt2 from anti-influenza_CDR
  source 1..42: mol_type = other RNA
caccccaagtacttctacggctccggctcctaccccgacttc

SEQ ID NO: 22519 - RNA, 42 nt, synthetic construct
  misc_feature 1..42: note = derived and/or modified sequence opt2 from anti-influenza_CDR
  source 1..42: mol_type = other RNA
accggctcctcctccgacgtcggcgcctccaactccgtctcc

SEQ ID NO: 22520 - RNA, 42 nt, synthetic construct
  misc_feature 1..42: note = derived and/or modified sequence opt2 from anti-influenza_CDR
  source 1..42: mol_type = other RNA
ggcgcctactacgactcctccggctaccccgccttctacatc

SEQ ID NO: 22521 - RNA, 42 nt, synthetic construct
  misc_feature 1..42: note = derived and/or modified sequence opt2 from anti-influenza_CDR
  source 1..42: mol_type = other RNA
accggctcctcctccaacatcggctccgactacgacgtccac

SEQ ID NO: 22522 - RNA, 42 nt, synthetic construct
  misc_feature 1..42: note = derived and/or modified sequence opt2 from anti-influenza_CDR
  source 1..42: mol_type = other RNA
gagttcgagacctccggctacttccacggctccttcgactac

SEQ ID NO: 22523 - RNA, 42 nt, synthetic construct
  misc_feature 1..42: note = derived and/or modified sequence opt2 from anti-influenza_CDR
  source 1..42: mol_type = other RNA
gcctcctccaccggcgccgtcacctcctcctacttccccaac

SEQ ID NO: 22524 - RNA, 42 nt, synthetic construct
  misc_feature 1..42: note = derived and/or modified sequence opt2 from anti-influenza_CDR
  source 1..42: mol_type = other RNA
accggcggctcctccgacatcggcgcctccaactccgtctcc

SEQ ID NO: 22525 - RNA, 42 nt, synthetic construct
  misc_feature 1..42: note = derived and/or modified sequence opt2 from anti-influenza_CDR
  source 1..42: mol_type = other RNA
accggctcctcctccgacgtcggcggctacgactacgtctcc

SEQ ID NO: 22526 - RNA, 42 nt, synthetic construct
  misc_feature 1..42: note = derived and/or modified sequence opt2 from anti-influenza_CDR
  source 1..42: mol_type = other RNA
ggctcctccaccggcgccgtcacccgcggccactacccctac

SEQ ID NO: 22527 - RNA, 42 nt, synthetic construct
  misc_feature 1..42: note = derived and/or modified sequence opt2 from anti-influenza_CDR
  source 1..42: mol_type = other RNA
ggctcctccaccggccccgtcacctccggccactacccctac

SEQ ID NO: 22528 - RNA, 42 nt, synthetic construct
  misc_feature 1..42: note = derived and/or modified sequence opt2 from anti-influenza_CDR
  source 1..42: mol_type = other RNA
cactacggcgactccgaggccatcaacgacgccttcgacatc

SEQ ID NO: 22529 - RNA, 42 nt, synthetic construct
  misc_feature 1..42: note = derived and/or modified sequence opt2 from anti-influenza_CDR
  source 1..42: mol_type = other RNA
accggctcctcctccaacatcggcgccggctacgacgtccac

SEQ ID NO: 22530 - RNA, 42 nt, synthetic construct
  misc_feature 1..42: note = derived and/or modified sequence opt2 from anti-influenza_CDR
  source 1..42: mol_type = other RNA
atcccccactacaacttcggctccggctcctacttcgactac

SEQ ID NO: 22531 - RNA, 42 nt, synthetic construct
  misc_feature 1..42: note = derived and/or modified sequence opt2 from anti-influenza_CDR
  source 1..42: mol_type = other RNA
accggcacctcctccgacgtcggcggctacaactacgtctcc

SEQ ID NO: 22532 - RNA, 42 nt, synthetic construct
  misc_feature 1..42: note = derived and/or modified sequence opt2 from anti-influenza_CDR
  source 1..42: mol_type = other RNA
accggcacctcctccgacgtcggcgcctacaactacgtctcc

SEQ ID NO: 22533 - RNA, 42 nt, synthetic construct
  misc_feature 1..42: note = derived and/or modified sequence opt2 from anti-influenza_CDR
  source 1..42: mol_type = other RNA
gccgagcgccccaaggtccgcggccaggccggccgcatgaac

SEQ ID NO: 22534 - RNA, 42 nt, synthetic construct
  misc_feature 1..42: note = derived and/or modified sequence opt2 from anti-influenza_CDR
  source 1..42: mol_type = other RNA
ggctcccgcccctgggtccgcggcgtctcctcccgcatctcc

SEQ ID NO: 22535 - RNA, 42 nt, synthetic construct
  misc_feature 1..42: note = derived and/or modified sequence opt2 from anti-influenza_CDR
  source 1..42: mol_type = other RNA
atctggggcgtcgccgcccccggcaccgccgccgcccagatc

SEQ ID NO: 22536 - RNA, 42 nt, synthetic construct
  misc_feature 1..42: note = derived and/or modified sequence opt2 from anti-influenza_CDR
  source 1..42: mol_type = other RNA
tgggtccgccagccccccggcaagggcctcgagtgggtcgcc

SEQ ID NO: 22537 - RNA, 42 nt, synthetic construct
  misc_feature 1..42: note = derived and/or modified sequence opt2 from anti-influenza_CDR
  source 1..42: mol_type = other RNA
gcccgcggccccgagggcgtctggggccgctccatcgactcc

SEQ ID NO: 22538 - RNA, 42 nt, synthetic construct
  misc_feature 1..42: note = derived and/or modified sequence opt2 from anti-influenza_CDR
  source 1..42: mol_type = other RNA
gcccgcgaccccgacacccccttcgtccgcgccttcgactcc

SEQ ID NO: 22539 - RNA, 42 nt, synthetic construct
  misc_feature 1..42: note = derived and/or modified sequence opt2 from anti-influenza_CDR
  source 1..42: mol_type = other RNA
accggctccacctccgacatcggctcctacaactacgtctcc

SEQ ID NO: 22540 - RNA, 42 nt, synthetic construct
  misc_feature 1..42: note = derived and/or modified sequence opt2 from anti-influenza_CDR
  source 1..42: mol_type = other RNA
tgggactggaacttcgacctctacctcggctggttcgacccc

SEQ ID NO: 22541 - RNA, 42 nt, synthetic construct
  misc_feature 1..42: note = derived and/or modified sequence opt2 from anti-influenza_CDR
  source 1..42: mol_type = other RNA
tgggcctggaacttcgacttcttcctcggctggttcgacccc

SEQ ID NO: 22542 - RNA, 42 nt, synthetic construct
  misc_feature 1..42: note = derived and/or modified sequence opt2 from anti-influenza_CDR
  source 1..42: mol_type = other RNA
ggccccggctactccggctaccactacggctggttcgacacc

SEQ ID NO: 22543 - RNA, 42 nt, synthetic construct
  misc_feature 1..42: note = derived and/or modified sequence opt2 from anti-influenza_CDR
  source 1..42: mol_type = other RNA
gcccgctgggactacggcgtctacgagggctacatcgactac

SEQ ID NO: 22544 - RNA, 45 nt, synthetic construct
  misc_feature 1..45: note = derived and/or modified sequence opt2 from anti-influenza_CDR
  source 1..45: mol_type = other RNA
gcccgcgccggcaccaccctcacccgcttcaactggttcgacccc

SEQ ID NO: 22545 - RNA, 45 nt, synthetic construct
  misc_feature 1..45: note = derived and/or modified sequence opt2 from anti-influenza_CDR
  source 1..45: mol_type = other RNA
gcccgcgccggcaccaccgtcacccgcttcaactggttcgacccc

SEQ ID NO: 22546 - RNA, 45 nt, synthetic construct
  misc_feature 1..45: note = derived and/or modified sequence opt2 from anti-influenza_CDR
  source 1..45: mol_type = other RNA
gcccgcggccagcgctactactacgaccgcgacggcatggacgtc

SEQ ID NO: 22547 - RNA, 45 nt, synthetic construct
  misc_feature 1..45: note = derived and/or modified sequence opt2 from anti-influenza_CDR
  source 1..45: mol_type = other RNA
gcccgctccggcggctacctcccccagaacaactggatcgacccc

SEQ ID NO: 22548 - RNA, 45 nt, synthetic construct
  misc_feature 1..45: note = derived and/or modified sequence opt2 from anti-influenza_CDR
  source 1..45: mol_type = other RNA
atggagaacgagcgcaccctcgacttccacgactccaacgtcaag

SEQ ID NO: 22549 - RNA, 45 nt, synthetic construct
  misc_feature 1..45: note = derived and/or modified sequence opt2 from anti-influenza_CDR
  source 1..45: mol_type = other RNA
ggcgccgaccacggctccggctccaacttcgtctccccctacgtc

SEQ ID NO: 22550 - RNA, 45 nt, synthetic construct
  misc_feature 1..45: note = derived and/or modified sequence opt2 from anti-influenza_CDR
  source 1..45: mol_type = other RNA
gacacccgctcctccctcgacaactaccagtacggcatggacgtc

SEQ ID NO: 22551 - RNA, 45 nt, synthetic construct
  misc_feature 1..45: note = derived and/or modified sequence opt2 from anti-influenza_CDR
  source 1..45: mol_type = other RNA
gaggactacgacatcctcaccggcgccggccccggcatggaggtc

SEQ ID NO: 22552 - RNA, 45 nt, synthetic construct
  misc_feature 1..45: note = derived and/or modified sequence opt2 from anti-influenza_CDR
  source 1..45: mol_type = other RNA
cacccctacgacgtcctcaccggctccggcgactggttcgacccc

SEQ ID NO: 22553 - RNA, 45 nt, synthetic construct
  misc_feature 1..45: note = derived and/or modified sequence opt2 from anti-influenza_CDR
  source 1..45: mol_type = other RNA
ggcgccgaccacggctccggcaacaacttcgtctccccctacgtc

SEQ ID NO: 22554 - RNA, 45 nt, synthetic construct
  misc_feature 1..45: note = derived and/or modified sequence opt2 from anti-influenza_CDR
  source 1..45: mol_type = other RNA
gtcatctactccggcggctccacctactacgccgactccgtcaag

SEQ ID NO: 22555 - RNA, 45 nt, synthetic construct
  misc_feature 1..45: note = derived and/or modified sequence opt2 from anti-influenza_CDR
  source 1..45: mol_type = other RNA
tggtaccagcagaagcccggcaaggcccccaagctcctcatctac

SEQ ID NO: 22556 - RNA, 45 nt, synthetic construct
  misc_feature 1..45: note = derived and/or modified sequence opt2 from anti-influenza_CDR
  source 1..45: mol_type = other RNA
gacccctacaacgacggcaccaagtacaacgagaagttcgagggc

SEQ ID NO: 22557 - RNA, 45 nt, synthetic construct
  misc_feature 1..45: note = derived and/or modified sequence opt2 from anti-influenza_CDR
  source 1..45: mol_type = other RNA
gcccgcgcccacaccgccctcacccgcttccgctggctcgacccc

SEQ ID NO: 22558 - RNA, 45 nt, synthetic construct
  misc_feature 1..45: note = derived and/or modified sequence opt2 from anti-influenza_CDR
  source 1..45: mol_type = other RNA
gcctccctcgactacgacttctcctactactaccaccgcgacgtc

SEQ ID NO: 22559 - RNA, 45 nt, synthetic construct
  misc_feature 1..45: note = derived and/or modified sequence opt2 from anti-influenza_CDR
  source 1..45: mol_type = other RNA
gcccgcgtcgccaccccctactactacgagtccggcttcgactac

SEQ ID NO: 22560 - RNA, 45 nt, synthetic construct
  misc_feature 1..45: note = derived and/or modified sequence opt2 from anti-influenza_CDR
  source 1..45: mol_type = other RNA
gcccgccgcggcggcggctggcagtactactacggcatggacgtc

SEQ ID NO: 22561 - RNA, 48 nt, synthetic construct
  misc_feature 1..48: note = derived and/or modified sequence opt2 from anti-influenza_CDR
  source 1..48: mol_type = other RNA
tccggccacatcaccgtcttcggcgtcaacgtcgacgccttcgacatg

SEQ ID NO: 22562 - RNA, 48 nt, synthetic construct
  misc_feature 1..48: note = derived and/or modified sequence opt2 from anti-influenza_CDR
  source 1..48: mol_type = other RNA
ggcggccacatcaccgtcttcggcctcaacatcgacgcctacgacatc

SEQ ID NO: 22563 - RNA, 48 nt, synthetic construct
  misc_feature 1..48: note = derived and/or modified sequence opt2 from anti-influenza_CDR
  source 1..48: mol_type = other RNA
ggcggccacatcaccgagttcggcctcaacatcgacgcctacgacatc

SEQ ID NO: 22564 - RNA, 48 nt, synthetic construct
  misc_feature 1..48: note = derived and/or modified sequence opt2 from anti-influenza_CDR
  source 1..48: mol_type = other RNA
ggcggccacatcaccgtcttcggcgtcaacatcgacgccttcgacatc

SEQ ID NO: 22565 - RNA, 48 nt, synthetic construct
  misc_feature 1..48: note = derived and/or modified sequence opt2 from anti-influenza_CDR
  source 1..48: mol_type = other RNA
ggcggccacatcaccgtcttcggcgtcaacatcgacgccttcgacgtc

SEQ ID NO: 22566 - RNA, 48 nt, synthetic construct
  misc_feature 1..48: note = derived and/or modified sequence opt2 from anti-influenza_CDR
  source 1..48: mol_type = other RNA
gcccgcgacggctggggccagcagctcgtcccctactacttcgactac

SEQ ID NO: 22567 - RNA, 48 nt, synthetic construct
  misc_feature 1..48: note = derived and/or modified sequence opt2 from anti-influenza_CDR
  source 1..48: mol_type = other RNA
gacttctgggtctcctactactacgactcctccgccccccccgccatc

SEQ ID NO: 22568 - RNA, 48 nt, synthetic construct
  misc_feature 1..48: note = derived and/or modified sequence opt2 from anti-influenza_CDR
  source 1..48: mol_type = other RNA
gcccgcgccggcgtcaagatcttcggcctcatcgtcggcgccctcgac

SEQ ID NO: 22569 - RNA, 48 nt, synthetic construct
  misc_feature 1..48: note = derived and/or modified sequence opt2 from anti-influenza_CDR
  source 1..48: mol_type = other RNA
gcccgcgacggcgccggctcctactaccccctcaactggttcgacccc

SEQ ID NO: 22570 - RNA, 48 nt, synthetic construct
  misc_feature 1..48: note = derived and/or modified sequence opt2 from anti-influenza_CDR
  source 1..48: mol_type = other RNA
gtcatctactcccacggccgcgcctactactccgcctccgtcaacggc

SEQ ID NO: 22571 - RNA, 48 nt, synthetic construct
  misc_feature 1..48: note = derived and/or modified sequence opt2 from anti-influenza_CDR
  source 1..48: mol_type = other RNA
gacaccctccacaacggctacaccaactacaacccctccctccgcggc

SEQ ID NO: 22572 - RNA, 48 nt, synthetic construct
  misc_feature 1..48: note = derived and/or modified sequence opt2 from anti-influenza_CDR
  source 1..48: mol_type = other RNA
tacatctcctacaacggccgccccaagtacaacccctccctcacctcc

SEQ ID NO: 22573 - RNA, 48 nt, synthetic construct
  misc_feature 1..48: note = derived and/or modified sequence opt2 from anti-influenza_CDR
  source 1..48: mol_type = other RNA
gagacccgcttcggcgagctcctctccccctacgacgccttcgagatc

SEQ ID NO: 22574 - RNA, 48 nt, synthetic construct
  misc_feature 1..48: note = derived and/or modified sequence opt2 from anti-influenza_CDR
  source 1..48: mol_type = other RNA
ctcatctactgggacgacgacaagcgctactccccctccctcaagcgc

SEQ ID NO: 22575 - RNA, 48 nt, synthetic construct
  misc_feature 1..48: note = derived and/or modified sequence opt2 from anti-influenza_CDR
  source 1..48: mol_type = other RNA
tacatctactacatcggcaacaccgactaccgcccctccctcaagtcc

SEQ ID NO: 22576 - RNA, 48 nt, synthetic construct
  misc_feature 1..48: note = derived and/or modified sequence opt2 from anti-influenza_CDR
  source 1..48: mol_type = other RNA
gagatctcccacggcggctccaccaactacaacccctccctcaagtcc

SEQ ID NO: 22577 - RNA, 48 nt, synthetic construct
  misc_feature 1..48: note = derived and/or modified sequence opt2 from anti-influenza_CDR
  source 1..48: mol_type = other RNA
gagatcaaccactccggccgcaccaactacaacccctccctcaagtcc

SEQ ID NO: 22578 - RNA, 48 nt, synthetic construct
  misc_feature 1..48: note = derived and/or modified sequence opt2 from anti-influenza_CDR
  source 1..48: mol_type = other RNA
ctcatctcctgggacgacgagaagcactactccccctccctccagtcc

SEQ ID NO: 22579 - RNA, 48 nt, synthetic construct
  misc_feature 1..48: note = derived and/or modified sequence opt2 from anti-influenza_CDR
  source 1..48: mol_type = other RNA
gagggcgtctacttcgactccggcacctaccgcggctacttcgactac

SEQ ID NO: 22580 - RNA, 48 nt, synthetic construct
  misc_feature 1..48: note = derived and/or modified sequence opt2 from anti-influenza_CDR
  source 1..48: mol_type = other RNA
tacatctaccactccggctccaccaactacaacccctccctcaagtcc

SEQ ID NO: 22581 - RNA, 48 nt, synthetic construct
  misc_feature 1..48: note = derived and/or modified sequence opt2 from anti-influenza_CDR
  source 1..48: mol_type = other RNA
tacatctactaccgcggctccaccttctacaacccctccctcaagtcc

SEQ ID NO: 22582 - RNA, 48 nt, synthetic construct
  misc_feature 1..48: note = derived and/or modified sequence opt2 from anti-influenza_CDR
  source 1..48: mol_type = other RNA
tacatctcctactccggctccaccaagtacaacccctccctccgctcc

SEQ ID NO: 22583 - RNA, 48 nt, synthetic construct
  misc_feature 1..48: note = derived and/or modified sequence opt2 from anti-influenza_CDR
  source 1..48: mol_type = other RNA
gagatcaagcactccggccgcaccaactacaacccctccctcgagtcc

SEQ ID NO: 22584 - RNA, 48 nt, synthetic construct
  misc_feature 1..48: note = derived and/or modified sequence opt2 from anti-influenza_CDR
  source 1..48: mol_type = other RNA
gagatcaaccactccggcggcaccaactacaacccctccctcaagcgc

SEQ ID NO: 22585 - RNA, 48 nt, synthetic construct
  misc_feature 1..48: note = derived and/or modified sequence opt2 from anti-influenza_CDR
  source 1..48: mol_type = other RNA
ttcatgtactactccgcctccacctactacaacccctccctcaagtcc

SEQ ID NO: 22586 - RNA, 48 nt, synthetic construct
  misc_feature 1..48: note = derived and/or modified sequence opt2 from anti-influenza_CDR
  source 1..48: mol_type = other RNA
tacgtctactactccggctccaccacctacaacccctccctcaagtcc

SEQ ID NO: 22587 - RNA, 48 nt, synthetic construct
  misc_feature 1..48: note = derived and/or modified sequence opt2 from anti-influenza_CDR
  source 1..48: mol_type = other RNA
aacatctactacaccggcatcaccttctacaacccctccctctcctcc

SEQ ID NO: 22588 - RNA, 48 nt, synthetic construct
  misc_feature 1..48: note = derived and/or modified sequence opt2 from anti-influenza_CDR
  source 1..48: mol_type = other RNA
ttcatctactacggcggcaacaccaagtacaacccctccctcaagtcc

SEQ ID NO: 22589 - RNA, 48 nt, synthetic construct
  misc_feature 1..48: note = derived and/or modified sequence opt2 from anti-influenza_CDR
  source 1..48: mol_type = other RNA
ttcatgttccactccggctccccccgctacaaccccaccctcaagtcc

SEQ ID NO: 22590 - RNA, 48 nt, synthetic construct
  misc_feature 1..48: note = derived and/or modified sequence opt2 from anti-influenza_CDR
  source 1..48: mol_type = other RNA
ttcttctacaacggcggctccaccaagtacaacccctccctcaagtcc

SEQ ID NO: 22591 - RNA, 48 nt, synthetic construct
  misc_feature 1..48: note = derived and/or modified sequence opt2 from anti-influenza_CDR
  source 1..48: mol_type = other RNA
cacatctacgactacggccgcaccttctacaactcctccctccagtcc

SEQ ID NO: 22592 - RNA, 48 nt, synthetic construct
  misc_feature 1..48: note = derived and/or modified sequence opt2 from anti-influenza_CDR
  source 1..48: mol_type = other RNA
gtcttctactccgagacccgcacctactacgccgactccgtcaagggc

SEQ ID NO: 22593 - RNA, 48 nt, synthetic construct
  misc_feature 1..48: note = derived and/or modified sequence opt2 from anti-influenza_CDR
  source 1..48: mol_type = other RNA
tacgtctacaaccgcggctccaccaagtactccccctccctcaagtcc

SEQ ID NO: 22594 - RNA, 48 nt, synthetic construct
  misc_feature 1..48: note = derived and/or modified sequence opt2 from anti-influenza_CDR
  source 1..48: mol_type = other RNA
tacatctacaaccgcggctccaccaagtacaccccctccctcaagtcc

SEQ ID NO: 22595 - RNA, 48 nt, synthetic construct
  misc_feature 1..48: note = derived and/or modified sequence opt2 from anti-influenza_CDR
  source 1..48: mol_type = other RNA
tacctctactactccggctccaccaagtacaacccctccctcaagtcc

SEQ ID NO: 22596 - RNA, 48 nt, synthetic construct
  misc_feature 1..48: note = derived and/or modified sequence opt2 from anti-influenza_CDR
  source 1..48: mol_type = other RNA
tacgtctacaactccggcaacaccaagtacaacccctccctcaagtcc

SEQ ID NO: 22597 - RNA, 48 nt, synthetic construct
  misc_feature 1..48: note = derived and/or modified sequence opt2 from anti-influenza_CDR
  source 1..48: mol_type = other RNA
cacatcttcgactccggctccacctactacaacccctccctcaagtcc

SEQ ID NO: 22598 - RNA, 48 nt, synthetic construct
  misc_feature 1..48: note = derived and/or modified sequence opt2 from anti-influenza_CDR
  source 1..48: mol_type = other RNA
gtcttctactccgccgaccgcacctcctacgccgactccgtcaagggc

SEQ ID NO: 22599 - RNA, 48 nt, synthetic construct
  misc_feature 1..48: note = derived and/or modified sequence opt2 from anti-influenza_CDR
  source 1..48: mol_type = other RNA
tacatctactactccggcaacacctactacaacccctccctcaagtcc

SEQ ID NO: 22600 - RNA, 48 nt, synthetic construct
  misc_feature 1..48: note = derived and/or modified sequence opt2 from anti-influenza_CDR
  source 1..48: mol_type = other RNA
cgctcctcccagtccctcctccactccaacggctacaactacctcgac

SEQ ID NO: 22601 - RNA, 48 nt, synthetic construct
  misc_feature 1..48: note = derived and/or modified sequence opt2 from anti-influenza_CDR
  source 1..48: mol_type = other RNA
accatctaccactccggctccacctactacaacccctccctcaagtcc

SEQ ID NO: 22602 - RNA, 48 nt, synthetic construct
  misc_feature 1..48: note = derived and/or modified sequence opt2 from anti-influenza_CDR
  source 1..48: mol_type = other RNA
cgctcctcccagtccctcctccactccaacggccacatctacttcgac

SEQ ID NO: 22603 - RNA, 48 nt, synthetic construct
  misc_feature 1..48: note = derived and/or modified sequence opt2 from anti-influenza_CDR
  source 1..48: mol_type = other RNA
atctggggcgtcgccgccccctccaccgcctccgcccagacctccctc

SEQ ID NO: 22604 - RNA, 48 nt, synthetic construct
  misc_feature 1..48: note = derived and/or modified sequence opt2 from anti-influenza_CDR
  source 1..48: mol_type = other RNA
cgctcctcccagtccctcctctacaccgacggcttcacctacctctcc

SEQ ID NO: 22605 - RNA, 48 nt, synthetic construct
  misc_feature 1..48: note = derived and/or modified sequence opt2 from anti-influenza_CDR
  source 1..48: mol_type = other RNA
gccaagccccgcctcgactacctcgactacttccacgccgccgactcc

SEQ ID NO: 22606 - RNA, 48 nt, synthetic construct
  misc_feature 1..48: note = derived and/or modified sequence opt2 from anti-influenza_CDR
  source 1..48: mol_type = other RNA
gcccgctcccccggctactccggctacctctacggctggttcgacccc

SEQ ID NO: 22607 - RNA, 48 nt, synthetic construct
  misc_feature 1..48: note = derived and/or modified sequence opt2 from anti-influenza_CDR
  source 1..48: mol_type = other RNA
gccatcgccggctccggctccgccgactacgcctcctgggccaagggc

SEQ ID NO: 22608 - RNA, 48 nt, synthetic construct
  misc_feature 1..48: note = derived and/or modified sequence opt2 from anti-influenza_CDR
  source 1..48: mol_type = other RNA
gccatcgccggctccggctccgccgactacgcctcctgggccaagtcc

SEQ ID NO: 22609 - RNA, 48 nt, synthetic construct
  misc_feature 1..48: note = derived and/or modified sequence opt2 from anti-influenza_CDR
  source 1..48: mol_type = other RNA
gccatcggcggcggcggctccgccgactacgcctcctgggccaagtcc

SEQ ID NO: 22610 - RNA, 48 nt, synthetic construct
  misc_feature 1..48: note = derived and/or modified sequence opt2 from anti-influenza_CDR
  source 1..48: mol_type = other RNA
cgctcctcccagtccctcctccgctccaacggctacaactacctcgac

SEQ ID NO: 22611 - RNA, 48 nt, synthetic construct
  misc_feature 1..48: note = derived and/or modified sequence opt2 from anti-influenza_CDR
  source 1..48: mol_type = other RNA
cagggcgaccacatcgcctggctcctccgcggcatcaacttcgactac

SEQ ID NO: 22612 - RNA, 51 nt, synthetic construct
  misc_feature 1..51: note = derived and/or modified sequence opt2 from anti-influenza_CDR
  source 1..51: mol_type = other RNA
gcccgcctcggctccggctcctaccacaacggccccaactggttcgacccc

SEQ ID NO: 22613 - RNA, 51 nt, synthetic construct
  misc_feature 1..51: note = derived and/or modified sequence opt2 from anti-influenza_CDR
  source 1..51: mol_type = other RNA
gcccgcgccgagaacctcctctccccctacctcgccgagggcttcgacccc

SEQ ID NO: 22614 - RNA, 51 nt, synthetic construct
  misc_feature 1..51: note = derived and/or modified sequence opt2 from anti-influenza_CDR
  source 1..51: mol_type = other RNA
gtcatctcctacgacggctccaacaagtactacgccgactccgtcaagggc

SEQ ID NO: 22615 - RNA, 51 nt, synthetic construct
  misc_feature 1..51: note = derived and/or modified sequence opt2 from anti-influenza_CDR
  source 1..51: mol_type = other RNA
ggcaccatccccctcctcggcaccaccaactacgcccagaagttccagggc

SEQ ID NO: 22616 - RNA, 51 nt, synthetic construct
  misc_feature 1..51: note = derived and/or modified sequence opt2 from anti-influenza_CDR
  source 1..51: mol_type = other RNA
ggcatcatcgccgtcttcaacaccgccaactacgcccagaagttccagggc

SEQ ID NO: 22617 - RNA, 51 nt, synthetic construct
  misc_feature 1..51: note = derived and/or modified sequence opt2 from anti-influenza_CDR
  source 1..51: mol_type = other RNA
aacatcgaggacgacggcggcgacaagtactacgtcgactccgtcaagggc

SEQ ID NO: 22618 - RNA, 51 nt, synthetic construct
  misc_feature 1..51: note = derived and/or modified sequence opt2 from anti-influenza_CDR
  source 1..51: mol_type = other RNA
tggatcaaccccaactccggcaccaccggctccgcccagcgcttccagggc

SEQ ID NO: 22619 - RNA, 51 nt, synthetic construct
  misc_feature 1..51: note = derived and/or modified sequence opt2 from anti-influenza_CDR
  source 1..51: mol_type = other RNA
ggcatcaaccccgtcttcggccgcccccactacgcccagaagttccagggc

SEQ ID NO: 22620 - RNA, 51 nt, synthetic construct
  misc_feature 1..51: note = derived and/or modified sequence opt2 from anti-influenza_CDR
  source 1..51: mol_type = other RNA
ggcatcatccccctcatcaacgcccccaactacgcccccaagttccagggc

SEQ ID NO: 22621 - RNA, 51 nt, synthetic construct
  misc_feature 1..51: note = derived and/or modified sequence opt2 from anti-influenza_CDR
  source 1..51: mol_type = other RNA
ggcatcatccccatgatgggcaccgtcaactacgcccagaagctccagggc

SEQ ID NO: 22622 - RNA, 51 nt, synthetic construct
  misc_feature 1..51: note = derived and/or modified sequence opt2 from anti-influenza_CDR
  source 1..51: mol_type = other RNA
ggcatcatccccctcttcggcgccgccaagtacgcccagaagttccagggc

SEQ ID NO: 22623 - RNA, 51 nt, synthetic construct
  misc_feature 1..51: note = derived and/or modified sequence opt2 from anti-influenza_CDR
  source 1..51: mol_type = other RNA
aagtcctcccagcgcgtcctctactcctccaacaacaagaactacctcgcc

SEQ ID NO: 22624 - RNA, 51 nt, synthetic construct
  misc_feature 1..51: note = derived and/or modified sequence opt2 from anti-influenza_CDR
  source 1..51: mol_type = other RNA
ctcatctccgacgacggctccaacaagttctacgccgactccgtcaagggc

SEQ ID NO: 22625 - RNA, 51 nt, synthetic construct
  misc_feature 1..51: note = derived and/or modified sequence opt2 from anti-influenza_CDR
  source 1..51: mol_type = other RNA
atcatctcctacgacggcaacgaccagtactacaccgactccgtcaagggc

SEQ ID NO: 22626 - RNA, 51 nt, synthetic construct
  misc_feature 1..51: note = derived and/or modified sequence opt2 from anti-influenza_CDR
  source 1..51: mol_type = other RNA
tggatctccacctacaacggcaacaccaacttcgcccagaacttccagggc

SEQ ID NO: 22627 - RNA, 51 nt, synthetic construct
  misc_feature 1..51: note = derived and/or modified sequence opt2 from anti-influenza_CDR
  source 1..51: mol_type = other RNA
gtcgagggctcctaccgcgacttctggaacaaccagaaccgcttcgacccc

SEQ ID NO: 22628 - RNA, 51 nt, synthetic construct
  misc_feature 1..51: note = derived and/or modified sequence opt2 from anti-influenza_CDR
  source 1..51: mol_type = other RNA
tggatcaaccccaactccggcgacaccaactacgcccagaagttccagggc

SEQ ID NO: 22629 - RNA, 51 nt, synthetic construct
  misc_feature 1..51: note = derived and/or modified sequence opt2 from anti-influenza_CDR
  source 1..51: mol_type = other RNA
aagtcctcccagtccgtcctctactcctccaacaacaagtcccacctcgcc

SEQ ID NO: 22630 - RNA, 51 nt, synthetic construct
  misc_feature 1..51: note = derived and/or modified sequence opt2 from anti-influenza_CDR
  source 1..51: mol_type = other RNA
atcatctaccccggcgactccgacacccgctactccccctccttccagggc

SEQ ID NO: 22631 - RNA, 51 nt, synthetic construct
  misc_feature 1..51: note = derived and/or modified sequence opt2 from anti-influenza_CDR
  source 1..51: mol_type = other RNA
ggcatcatccccgtcttccccacccccaactacgcccagatgttccagggc

SEQ ID NO: 22632 - RNA, 51 nt, synthetic construct
  misc_feature 1..51: note = derived and/or modified sequence opt2 from anti-influenza_CDR
  source 1..51: mol_type = other RNA
ggcatcgtccccgtcttcggcaccgccaactacgcccagaagttccagggc

SEQ ID NO: 22633 - RNA, 51 nt, synthetic construct
  misc_feature 1..51: note = derived and/or modified sequence opt2 from anti-influenza_CDR
  source 1..51: mol_type = other RNA
tggatcaaccccgagtccggcgacaccaagtacgcccagaagttccagggc

SEQ ID NO: 22634 - RNA, 51 nt, synthetic construct
  misc_feature 1..51: note = derived and/or modified sequence opt2 from anti-influenza_CDR
  source 1..51: mol_type = other RNA
cgctcctcccagtccatcttccacaactccaacaacgagaactacctcgcc

SEQ ID NO: 22635 - RNA, 51 nt, synthetic construct
  misc_feature 1..51: note = derived and/or modified sequence opt2 from anti-influenza_CDR
  source 1..51: mol_type = other RNA
tggatcaacgccaagcgcggcggcaccaactacgcccagaagttccagggc

SEQ ID NO: 22636 - RNA, 51 nt, synthetic construct
  misc_feature 1..51: note = derived and/or modified sequence opt2 from anti-influenza_CDR
  source 1..51: mol_type = other RNA
tggatcaaccccgactccggcgccacctcctccgcccagaacttccagggc

SEQ ID NO: 22637 - RNA, 51 nt, synthetic construct
  misc_feature 1..51: note = derived and/or modified sequence opt2 from anti-influenza_CDR
  source 1..51: mol_type = other RNA
tggatctcccccgactccgacgccaccaagtacgcccagaagttccagggc

SEQ ID NO: 22638 - RNA, 51 nt, synthetic construct
  misc_feature 1..51: note = derived and/or modified sequence opt2 from anti-influenza_CDR
  source 1..51: mol_type = other RNA
aacatcaagcaggacggccgcgagaagtactacgtcgactccctccgcggc

SEQ ID NO: 22639 - RNA, 51 nt, synthetic construct
  misc_feature 1..51: note = derived and/or modified sequence opt2 from anti-influenza_CDR
  source 1..51: mol_type = other RNA
ggcatcatcgccatcttcggcacccccaagtacgcccagaagttccagggc

SEQ ID NO: 22640 - RNA, 51 nt, synthetic construct
  misc_feature 1..51: note = derived and/or modified sequence opt2 from anti-influenza_CDR
  source 1..51: mol_type = other RNA
aagtcctcccagtccatcctcaactcctccaacaacaagaactacctcgcc

SEQ ID NO: 22641 - RNA, 51 nt, synthetic construct
  misc_feature 1..51: note = derived and/or modified sequence opt2 from anti-influenza_CDR
  source 1..51: mol_type = other RNA
tggatctccgcctacaacggcaacaccaactacgcccagaagttccagggc

SEQ ID NO: 22642 - RNA, 51 nt, synthetic construct
  misc_feature 1..51: note = derived and/or modified sequence opt2 from anti-influenza_CDR
  source 1..51: mol_type = other RNA
ggcgtcatccccatcttccgcaccgccaactacgcccagaacttccagggc

SEQ ID NO: 22643 - RNA, 51 nt, synthetic construct
  misc_feature 1..51: note = derived and/or modified sequence opt2 from anti-influenza_CDR
  source 1..51: mol_type = other RNA
ggcatcatcgccatcttccacacccccaagtacgcccagaagttccagggc

SEQ ID NO: 22644 - RNA, 51 nt, synthetic construct
  misc_feature 1..51: note = derived and/or modified sequence opt2 from anti-influenza_CDR
  source 1..51: mol_type = other RNA
ggcatctcccccatgttcggcaccaccacctacgcccagaagttccagggc

SEQ ID NO: 22645 - RNA, 51 nt, synthetic construct
  misc_feature 1..51: note = derived and/or modified sequence opt2 from anti-influenza_CDR
  source 1..51: mol_type = other RNA
aagtcctcccagtccgtcctctactcctccaacaacaagaactacctcgcc

SEQ ID NO: 22646 - RNA, 51 nt, synthetic construct
  misc_feature 1..51: note = derived and/or modified sequence opt2 from anti-influenza_CDR
  source 1..51: mol_type = other RNA
ggcatcatccccatcttcggcaccaccaagtacgcccccaagttccagggc

SEQ ID NO: 22647 - RNA, 51 nt, synthetic construct
  misc_feature 1..51: note = derived and/or modified sequence opt2 from anti-influenza_CDR
  source 1..51: mol_type = other RNA
ggcatctcccccctcttcggcaccaccaactacgcccagaagttccagggc

SEQ ID NO: 22648 - RNA, 51 nt, synthetic construct
  misc_feature 1..51: note = derived and/or modified sequence opt2 from anti-influenza_CDR
  source 1..51: mol_type = other RNA
ggcatcatgggcatgttcggcaccaccaactacgcccagaagttccagggc

SEQ ID NO: 22649 - RNA, 51 nt, synthetic construct
  misc_feature 1..51: note = derived and/or modified sequence opt2 from anti-influenza_CDR
  source 1..51: mol_type = other RNA
ggcatcatcggcatgttcggctccaccaactacgcccagaacttccagggc

SEQ ID NO: 22650 - RNA, 51 nt, synthetic construct
  misc_feature 1..51: note = derived and/or modified sequence opt2 from anti-influenza_CDR
  source 1..51: mol_type = other RNA
tggatcaaccccaactccggcggcaccaactacgcccagaagttccagggc

SEQ ID NO: 22651 - RNA, 51 nt, synthetic construct
  misc_feature 1..51: note = derived and/or modified sequence opt2 from anti-influenza_CDR
  source 1..51: mol_type = other RNA
gccatctcctcctccggcgactccacctactacgccgactccgtcaagggc

SEQ ID NO: 22652 - RNA, 51 nt, synthetic construct
  misc_feature 1..51: note = derived and/or modified sequence opt2 from anti-influenza_CDR
  source 1..51: mol_type = other RNA
tccatctcctcctcctcctcctacatctactacgtcgactccgtcaagggc

SEQ ID NO: 22653 - RNA, 51 nt, synthetic construct
  misc_feature 1..51: note = derived and/or modified sequence opt2 from anti-influenza_CDR
  source 1..51: mol_type = other RNA
gacatcatcggcatgttcggctccaccaactacgcccagaacttccagggc

SEQ ID NO: 22654 - RNA, 51 nt, synthetic construct
  misc_feature 1..51: note = derived and/or modified sequence opt2 from anti-influenza_CDR
  source 1..51: mol_type = other RNA
ggcatcatccccatgttcggcaccaccaactacgcccagaagttccagggc

SEQ ID NO: 22655 - RNA, 51 nt, synthetic construct
  misc_feature 1..51: note = derived and/or modified sequence opt2 from anti-influenza_CDR
  source 1..51: mol_type = other RNA
ggcatcatcgccatcttcggcaccgccaactacgcccagaagttccagggc

SEQ ID NO: 22656 - RNA, 51 nt, synthetic construct
  misc_feature 1..51: note = derived and/or modified sequence opt2 from anti-influenza_CDR
  source 1..51: mol_type = other RNA
ggcatcatccccatcttcggcaccaccaactacgcccagaagttccagggc

SEQ ID NO: 22657 - RNA, 51 nt, synthetic construct
  misc_feature 1..51: note = derived and/or modified sequence opt2 from anti-influenza_CDR
  source 1..51: mol_type = other RNA
ggcatcttcgccctcttcggcaccaccgactacgcccagaagttccagggc

SEQ ID NO: 22658 - RNA, 51 nt, synthetic construct
  misc_feature 1..51: note = derived and/or modified sequence opt2 from anti-influenza_CDR
  source 1..51: mol_type = other RNA
ggcatcatcggcatgttcggcaccgccaactacgcccagaagttccagggc

SEQ ID NO: 22659 - RNA, 51 nt, synthetic construct
  misc_feature 1..51: note = derived and/or modified sequence opt2 from anti-influenza_CDR
  source 1..51: mol_type = other RNA
ggcatcatcgccgtcttcggcaccaccaagtacgcccacaagttccagggc

SEQ ID NO: 22660 - RNA, 51 nt, synthetic construct
  misc_feature 1..51: note = derived and/or modified sequence opt2 from anti-influenza_CDR
  source 1..51: mol_type = other RNA
ggcatcctcggcgtcttcggctccccctcctacgcccagaagttccagggc

SEQ ID NO: 22661 - RNA, 51 nt, synthetic construct
  misc_feature 1..51: note = derived and/or modified sequence opt2 from anti-influenza_CDR
  source 1..51: mol_type = other RNA
ggcatcttcggcatgttcggcaccgccaactacgcccagaagttccagggc

SEQ ID NO: 22662 - RNA, 51 nt, synthetic construct
  misc_feature 1..51: note = derived and/or modified sequence opt2 from anti-influenza_CDR
  source 1..51: mol_type = other RNA
tggatctccgcctacaccggcgacaccgactacgcccagaagttccagggc

SEQ ID NO: 22663 - RNA, 51 nt, synthetic construct
  misc_feature 1..51: note = derived and/or modified sequence opt2 from anti-influenza_CDR
  source 1..51: mol_type = other RNA
tccttcgaccccgaggacggcgagaccatctacgcccagaagttccagggc

SEQ ID NO: 22664 - RNA, 51 nt, synthetic construct
  misc_feature 1..51: note = derived and/or modified sequence opt2 from anti-influenza_CDR
  source 1..51: mol_type = other RNA
ggcatctccggctccggcgagtccacctactacgccgactccgtcaagggc

SEQ ID NO: 22665 - RNA, 51 nt, synthetic construct
  misc_feature 1..51: note = derived and/or modified sequence opt2 from anti-influenza_CDR
  source 1..51: mol_type = other RNA
gtcgtctcctacgacggcaactacaagtactacgccgactccgtccagggc

SEQ ID NO: 22666 - RNA, 51 nt, synthetic construct
  misc_feature 1..51: note = derived and/or modified sequence opt2 from anti-influenza_CDR
  source 1..51: mol_type = other RNA
ggctccatctcctactccggctccacctactaccacccctccctcaagtcc

SEQ ID NO: 22667 - RNA, 51 nt, synthetic construct
  misc_feature 1..51: note = derived and/or modified sequence opt2 from anti-influenza_CDR
  source 1..51: mol_type = other RNA
acccgcggccgccccatcggccgcaactgggagccccgcgacaaggactac

SEQ ID NO: 22668 - RNA, 51 nt, synthetic construct
  misc_feature 1..51: note = derived and/or modified sequence opt2 from anti-influenza_CDR
  source 1..51: mol_type = other RNA
gcccgcgaggccggctaccactcctccttctccggcgtctacttcgactac

SEQ ID NO: 22669 - RNA, 51 nt, synthetic construct
  misc_feature 1..51: note = derived and/or modified sequence opt2 from anti-influenza_CDR
  source 1..51: mol_type = other RNA
cgcatcgaccccaacggctccggcaccacctacgcccagaagttccagggc

SEQ ID NO: 22670 - RNA, 51 nt, synthetic construct
  misc_feature 1..51: note = derived and/or modified sequence opt2 from anti-influenza_CDR
  source 1..51: mol_type = other RNA
cgcatcgaccccaacggcgccggcaccacctacgcccagaagttccagggc

SEQ ID NO: 22671 - RNA, 51 nt, synthetic construct
  misc_feature 1..51: note = derived and/or modified sequence opt2 from anti-influenza_CDR
  source 1..51: mol_type = other RNA
tggatcgaccccaacaacgacggcaccatctacgcccagaagttccagggc

SEQ ID NO: 22672 - RNA, 51 nt, synthetic construct
  misc_feature 1..51: note = derived and/or modified sequence opt2 from anti-influenza_CDR
  source 1..51: mol_type = other RNA
atgatgtaccccggcgactccgacaccatctactccccctccttccagggc

SEQ ID NO: 22673 - RNA, 51 nt, synthetic construct
  misc_feature 1..51: note = derived and/or modified sequence opt2 from anti-influenza_CDR
  source 1..51: mol_type = other RNA
atgatgtaccccggcgacgccgacgccatctactccccctccttccagggc

SEQ ID NO: 22674 - RNA, 51 nt, synthetic construct
  misc_feature 1..51: note = derived and/or modified sequence opt2 from anti-influenza_CDR
  source 1..51: mol_type = other RNA
atgatgtaccccggcgagtccgagaccatctactccccctccttccagggc

SEQ ID NO: 22675 - RNA, 51 nt, synthetic construct
  misc_feature 1..51: note = derived and/or modified sequence opt2 from anti-influenza_CDR
  source 1..51: mol_type = other RNA
atgatgtaccccggcgacgccgacaccatctactccccctccttccagggc

SEQ ID NO: 22676 - RNA, 51 nt, synthetic construct
  misc_feature 1..51: note = derived and/or modified sequence opt2 from anti-influenza_CDR
  source 1..51: mol_type = other RNA
atgatgtaccccggctcctccgacaccatctactccccctccttccagggc

SEQ ID NO: 22677 - RNA, 51 nt, synthetic construct
  misc_feature 1..51: note = derived and/or modified sequence opt2 from anti-influenza_CDR
  source 1..51: mol_type = other RNA
atgatgtaccccggcgactccgacgccatctactccccctccttccagggc

SEQ ID NO: 22678 - RNA, 51 nt, synthetic construct
  misc_feature 1..51: note = derived and/or modified sequence opt2 from anti-influenza_CDR
  source 1..51: mol_type = other RNA
atgatgtaccccggcgacaccgacaccatctactccccctccttccagggc

SEQ ID NO: 22679 - RNA, 51 nt, synthetic construct
  misc_feature 1..51: note = derived and/or modified sequence opt2 from anti-influenza_CDR
  source 1..51: mol_type = other RNA
atgatgtaccccggcgagtccgacaccatctactccccctccttccagggc

SEQ ID NO: 22680 - RNA, 51 nt, synthetic construct
  misc_feature 1..51: note = derived and/or modified sequence opt2 from anti-influenza_CDR
  source 1..51: mol_type = other RNA
gtcatctcctgggactccggccgcatcggctacgccgactccgtcaagggc

SEQ ID NO: 22681 - RNA, 51 nt, synthetic construct
  misc_feature 1..51: note = derived and/or modified sequence opt2 from anti-influenza_CDR
  source 1..51: mol_type = other RNA
gtccgctccggcgcctactacttcaactacctcgtcccctacttcgactac

SEQ ID NO: 22682 - RNA, 51 nt, synthetic construct
  misc_feature 1..51: note = derived and/or modified sequence opt2 from anti-influenza_CDR
  source 1..51: mol_type = other RNA
gtccgctccggcgcctactacgtcaactacctcgtcccctacttcgactac

SEQ ID NO: 22683 - RNA, 51 nt, synthetic construct
  misc_feature 1..51: note = derived and/or modified sequence opt2 from anti-influenza_CDR
  source 1..51: mol_type = other RNA
atcatctcctgggactccggccgcatcggctacgccgactccgtccgcggc

SEQ ID NO: 22684 - RNA, 51 nt, synthetic construct
  misc_feature 1..51: note = derived and/or modified sequence opt2 from anti-influenza_CDR
  source 1..51: mol_type = other RNA
cacggcggcgtctactactacggctccgcctcctccggctggttcgacccc

SEQ ID NO: 22685 - RNA, 54 nt, synthetic construct
  misc_feature 1..54: note = derived and/or modified sequence opt2 from anti-influenza_CDR
  source 1..54: mol_type = other RNA
cgcacctactaccgctccaagtggtacaacgactacgccgagtccgtcaagtcc

SEQ ID NO: 22686 - RNA, 54 nt, synthetic construct
  misc_feature 1..54: note = derived and/or modified sequence opt2 from anti-influenza_CDR
  source 1..54: mol_type = other RNA
cgcacctactaccgctccaagtggtactacgactacgccgagtccgtcaagtcc

SEQ ID NO: 22687 - RNA, 54 nt, synthetic construct
  misc_feature 1..54: note = derived and/or modified sequence opt2 from anti-influenza_CDR
  source 1..54: mol_type = other RNA
cgcacctactaccgctccaagtggtacaacgactacgccgtctccgtcaagtcc

SEQ ID NO: 22688 - RNA, 54 nt, synthetic construct
  misc_feature 1..54: note = derived and/or modified sequence opt2 from anti-influenza_CDR
  source 1..54: mol_type = other RNA
cgcacctactaccgctccaagtggtacaacgactacgccgacttcctcaagcgc

SEQ ID NO: 22689 - RNA, 54 nt, synthetic construct
  misc_feature 1..54: note = derived and/or modified sequence opt2 from anti-influenza_CDR
  source 1..54: mol_type = other RNA
cgcacctactaccgctccggctggtacaacgactacgccgagtccgtcaagtcc

SEQ ID NO: 22690 - RNA, 54 nt, synthetic construct
  misc_feature 1..54: note = derived and/or modified sequence opt2 from anti-influenza_CDR
  source 1..54: mol_type = other RNA
gcccgcctcggcggcaacaaggactacggcgactacctctggtacttcgacctc

SEQ ID NO: 22691 - RNA, 54 nt, synthetic construct
  misc_feature 1..54: note = derived and/or modified sequence opt2 from anti-influenza_CDR
  source 1..54: mol_type = other RNA
gccaaggacaccgccgaccacggcgactacgtcgacctcggcttcttcgacgcc

SEQ ID NO: 22692 - RNA, 54 nt, synthetic construct
  misc_feature 1..54: note = derived and/or modified sequence opt2 from anti-influenza_CDR
  source 1..54: mol_type = other RNA
gcccgctccggcatcttcgactggtccgcccccctcgtcgaggccttcgacatc

SEQ ID NO: 22693 - RNA, 54 nt, synthetic construct
  misc_feature 1..54: note = derived and/or modified sequence opt2 from anti-influenza_CDR
  source 1..54: mol_type = other RNA
gcccgccacgcctcctgctccgcccgctcctgctactggggccccgtcgactac

SEQ ID NO: 22694 - RNA, 54 nt, synthetic construct
  misc_feature 1..54: note = derived and/or modified sequence opt2 from anti-influenza_CDR
  source 1..54: mol_type = other RNA
gacgccccccccaacgtcgaggtcgcctccatgaccaactggtacttcgacctc

SEQ ID NO: 22695 - RNA, 54 nt, synthetic construct
  misc_feature 1..54: note = derived and/or modified sequence opt2 from anti-influenza_CDR
  source 1..54: mol_type = other RNA
ctccgcaccgactacggcgaccccgactccgtctactactacggcatggacgtc

SEQ ID NO: 22696 - RNA, 54 nt, synthetic construct
  misc_feature 1..54: note = derived and/or modified sequence opt2 from anti-influenza_CDR
  source 1..54: mol_type = other RNA
ggcacctgcgccggcgactgctccctccactactactactacggcctcgacgtc

SEQ ID NO: 22697 - RNA, 54 nt, synthetic construct
  misc_feature 1..54: note = derived and/or modified sequence opt2 from anti-influenza_CDR
  source 1..54: mol_type = other RNA
cacgtctccgtctcccacggcggccgcaccaagtccaacccctccgtcatgtcc

SEQ ID NO: 22698 - RNA, 54 nt, synthetic construct
  misc_feature 1..54: note = derived and/or modified sequence opt2 from anti-influenza_CDR
  source 1..54: mol_type = other RNA
gccctcatctacttcgacggctccaagcagtactacgccgactccgtcaagggc

SEQ ID NO: 22699 - RNA, 54 nt, synthetic construct
  misc_feature 1..54: note = derived and/or modified sequence opt2 from anti-influenza_CDR
  source 1..54: mol_type = other RNA
accctcatctcctacgacggcgccaaccagtactacgccgactccgtcaagggc

SEQ ID NO: 22700 - RNA, 54 nt, synthetic construct
  misc_feature 1..54: note = derived and/or modified sequence opt2 from anti-influenza_CDR
  source 1..54: mol_type = other RNA
gccgtccccggccccgtcttcggcatcttccccccctggtcctacttcgacaac

SEQ ID NO: 22701 - RNA, 54 nt, synthetic construct
  misc_feature 1..54: note = derived and/or modified sequence opt2 from anti-influenza_CDR
  source 1..54: mol_type = other RNA
ggcggcatcatccccatcttcggcgccgccaactacgcccagaagttccagggc

SEQ ID NO: 22702 - RNA, 54 nt, synthetic construct
  misc_feature 1..54: note = derived and/or modified sequence opt2 from anti-influenza_CDR
  source 1..54: mol_type = other RNA
ggctggatctccgcctacaccggcaacacccactacgccaagaacttcgagggc

SEQ ID NO: 22703 - RNA, 54 nt, synthetic construct
  misc_feature 1..54: note = derived and/or modified sequence opt2 from anti-influenza_CDR
  source 1..54: mol_type = other RNA
ggctggatcaaccccaacttcggcggcacccactacgcccgcaagttccagggc

SEQ ID NO: 22704 - RNA, 54 nt, synthetic construct
  misc_feature 1..54: note = derived and/or modified sequence opt2 from anti-influenza_CDR
  source 1..54: mol_type = other RNA
gtccgctggcgcgccgccgccgtcatcatggaccagttctacaagatggacgtc

SEQ ID NO: 22705 - RNA, 54 nt, synthetic construct
  misc_feature 1..54: note = derived and/or modified sequence opt2 from anti-influenza_CDR
  source 1..54: mol_type = other RNA
gccgtccccggccccatcttcggcatcttccccccctggtcctacttcgaccac

SEQ ID NO: 22706 - RNA, 54 nt, synthetic construct
  misc_feature 1..54: note = derived and/or modified sequence opt2 from anti-influenza_CDR
  source 1..54: mol_type = other RNA
gccgcctccaccgccacctccggcacctactacgccatgcgccccttcgacttc

SEQ ID NO: 22707 - RNA, 57 nt, synthetic construct
  misc_feature 1..57: note = derived and/or modified sequence opt2 from anti-influenza_CDR
  source 1..57: mol_type = other RNA
gcccgcggcaagcgccccggctactgctccggcggcgtctgctcctccgactactgg

SEQ ID NO: 22708 - RNA, 57 nt, synthetic construct
  misc_feature 1..57: note = derived and/or modified sequence opt2 from anti-influenza_CDR
  source 1..57: mol_type = other RNA
gcccgccactacccctactacgacctccccaccggcttctactcccagttcgacttc

SEQ ID NO: 22709 - RNA, 57 nt, synthetic construct
  misc_feature 1..57: note = derived and/or modified sequence opt2 from anti-influenza_CDR
  source 1..57: mol_type = other RNA
ggctccggcggctacggcggcttcgactacttcggcaagctccgcacctgggacttc

SEQ ID NO: 22710 - RNA, 57 nt, synthetic construct
  misc_feature 1..57: note = derived and/or modified sequence opt2 from anti-influenza_CDR
  source 1..57: mol_type = other RNA
ttcatccgcacccgcccctggggcggcaccgccgacaccgccgcctccgtcaagggc

SEQ ID NO: 22711 - RNA, 57 nt, synthetic construct
  misc_feature 1..57: note = derived and/or modified sequence opt2 from anti-influenza_CDR
  source 1..57: mol_type = other RNA
ctcaactaccacgactccggcacctactacaacgccccccgcggctggttcgacccc

SEQ ID NO: 22712 - RNA, 57 nt, synthetic construct
  misc_feature 1..57: note = derived and/or modified sequence opt2 from anti-influenza_CDR
  source 1..57: mol_type = other RNA
gtcaaggacggctactgcaccctcacctcctgccccgtcggctggtacttcgacctc

SEQ ID NO: 22713 - RNA, 57 nt, synthetic construct
  misc_feature 1..57: note = derived and/or modified sequence opt2 from anti-influenza_CDR
  source 1..57: mol_type = other RNA
gccgtccccggccccatcttcggcatcttccccccctggtcctacttcgaccactgg

SEQ ID NO: 22714 - RNA, 57 nt, synthetic construct
  misc_feature 1..57: note = derived and/or modified sequence opt2 from anti-influenza_CDR
  source 1..57: mol_type = other RNA
gcccgcgccatgatccagggcgtcgtcaccctctacctccgccccggcgactactgg

SEQ ID NO: 22715 - RNA, 57 nt, synthetic construct
  misc_feature 1..57: note = derived and/or modified sequence opt2 from anti-influenza_CDR
  source 1..57: mol_type = other RNA
gccaaggtcggcccctacaccggctacgacgactacaactactacggcatggacgtc

SEQ ID NO: 22716 - RNA, 57 nt, synthetic construct
  misc_feature 1..57: note = derived and/or modified sequence opt2 from anti-influenza_CDR
  source 1..57: mol_type = other RNA
gccaaggtcgagcgctccttctacgacggctccggctacggcgacgccctcgagatc

SEQ ID NO: 22717 - RNA, 57 nt, synthetic construct
  misc_feature 1..57: note = derived and/or modified sequence opt2 from anti-influenza_CDR
  source 1..57: mol_type = other RNA
tactgcgcccgcggccgcgtcaactccggctacgactggggccccaacttcgactcc

SEQ ID NO: 22718 - RNA, 57 nt, synthetic construct
  misc_feature 1..57: note = derived and/or modified sequence opt2 from anti-influenza_CDR
  source 1..57: mol_type = other RNA
ttctgcgcccgcggctcccccaactccggctacgactggggcccccacttcgactac

SEQ ID NO: 22719 - RNA, 57 nt, synthetic construct
  misc_feature 1..57: note = derived and/or modified sequence opt2 from anti-influenza_CDR
  source 1..57: mol_type = other RNA
cgcatcaagtccaacaccgacggcggcaccaccgactacgccgcccccgtcaagggc

SEQ ID NO: 22720 - RNA, 57 nt, synthetic construct
  misc_feature 1..57: note = derived and/or modified sequence opt2 from anti-influenza_CDR
  source 1..57: mol_type = other RNA
ctccgcctccagggcgaggtcgtcgtccccccctcccagtccaactggttcgacccc

SEQ ID NO: 22721 - RNA, 60 nt, synthetic construct
  misc_feature 1..60: note = derived and/or modified sequence opt2 from anti-influenza_CDR
  source 1..60: mol_type = other RNA
gccaaggagggcggcaacaccatcttcggcctcgtcaccatggcctactacttcgactcc

SEQ ID NO: 22722 - RNA, 60 nt, synthetic construct
  misc_feature 1..60: note = derived and/or modified sequence opt2 from anti-influenza_CDR
  source 1..60: mol_type = other RNA
gcccgcgccggcggcgactcctccggctactacggcgccctcggccgcttcttccagcac

SEQ ID NO: 22723 - RNA, 60 nt, synthetic construct
  misc_feature 1..60: note = derived and/or modified sequence opt2 from anti-influenza_CDR
  source 1..60: mol_type = other RNA
gccaaggactcccgcggctactgctcctccatcatctgcttcgagggcggcctcgacaac

SEQ ID NO: 22724 - RNA, 60 nt, synthetic construct
  misc_feature 1..60: note = derived and/or modified sequence opt2 from anti-influenza_CDR
  source 1..60: mol_type = other RNA
ggctccggctcctccgaccgctccgactacgacccccactactactactacctcgacgtc

SEQ ID NO: 22725 - RNA, 60 nt, synthetic construct
  misc_feature 1..60: note = derived and/or modified sequence opt2 from anti-influenza_CDR
  source 1..60: mol_type = other RNA
ggcaccgaccccgacaccgaggtctactgccgcgtcggcaactgcgccgccttcgactac

SEQ ID NO: 22726 - RNA, 60 nt, synthetic construct
  misc_feature 1..60: note = derived and/or modified sequence opt2 from anti-influenza_CDR
  source 1..60: mol_type = other RNA
ggcacctcccacgtctcccgctacttcgactggctcccccccaccaactggttcgacccc

SEQ ID NO: 22727 - RNA, 60 nt, synthetic construct
  misc_feature 1..60: note = derived and/or modified sequence opt2 from anti-influenza_CDR
  source 1..60: mol_type = other RNA
ggcaccgaccccgacaccgagggctactgccgctccggctcctgctccgccttcgacttc

SEQ ID NO: 22728 - RNA, 60 nt, synthetic construct
  misc_feature 1..60: note = derived and/or modified sequence opt2 from anti-influenza_CDR
  source 1..60: mol_type = other RNA
ggcaccgaccccgacaccgaggtctactgccgcgccggcaactgcgccgccttcgacttc

SEQ ID NO: 22729 - RNA, 60 nt, synthetic construct
  misc_feature 1..60: note = derived and/or modified sequence opt2 from anti-influenza_CDR
  source 1..60: mol_type = other RNA
cgcggcggccactccttcggctacggctccggcggcgacacccactccgagttcgactcc

SEQ ID NO: 22730 - RNA, 60 nt, synthetic construct
  misc_feature 1..60: note = derived and/or modified sequence opt2 from anti-influenza_CDR
  source 1..60: mol_type = other RNA
cacatgtccatgcagcaggtcgtctccgccggctgggagcgcgccgacctcgtcggcgac

SEQ ID NO: 22731 - RNA, 60 nt, synthetic construct
  misc_feature 1..60: note = derived and/or modified sequence opt2 from anti-influenza_CDR
  source 1..60: mol_type = other RNA
gactcccgcctccgctccctcctctacttcgagtggctctcccagggctacttcaacccc

SEQ ID NO: 22732 - RNA, 60 nt, synthetic construct
  misc_feature 1..60: note = derived and/or modified sequence opt2 from anti-influenza_CDR
  source 1..60: mol_type = other RNA
gcccgccacctcggccagcagctcgtctccaacacctactactactacggcatggacgtc

SEQ ID NO: 22733 - RNA, 63 nt, synthetic construct
  misc_feature 1..63: note = derived and/or modified sequence opt2 from anti-influenza_CDR
  source 1..63: mol_type = other RNA
accaccggcggcaccaccacctgcaccgccgccggctgcggcggcggctgctgcacctgctgc

SEQ ID NO: 22734 - RNA, 63 nt, synthetic construct
  misc_feature 1..63: note = derived and/or modified sequence opt2 from anti-influenza_CDR
  source 1..63: mol_type = other RNA
gcccgcgccgccgacgagtccgtcgagtccctcaccatcaaggccttccgcaccaactaccac

SEQ ID NO: 22735 - RNA, 63 nt, synthetic construct
  misc_feature 1..63: note = derived and/or modified sequence opt2 from anti-influenza_CDR
  source 1..63: mol_type = other RNA
gcccgcatgcccctcgccaactacgacctcctcaccggcctctacatcggcgccttcgacctc

SEQ ID NO: 22736 - RNA, 63 nt, synthetic construct
  misc_feature 1..63: note = derived and/or modified sequence opt2 from anti-influenza_CDR
  source 1..63: mol_type = other RNA
gacatgctcgcctactactccgacaactccggcaagaagtacaacgtctacggcatggacgtc

SEQ ID NO: 22737 - RNA, 63 nt, synthetic construct
  misc_feature 1..63: note = derived and/or modified sequence opt2 from anti-influenza_CDR
  source 1..63: mol_type = other RNA
gacatgctcgcctactactacgacggctccggcatccgctacaacctctacggcatggacgtc

SEQ ID NO: 22738 - RNA, 66 nt, synthetic construct
  misc_feature 1..66: note = derived and/or modified sequence opt2 from anti-influenza_CDR
  source 1..66: mol_type = other RNA
gccaaggacccccgcctccgccacctcctctacttccccttcacctccatgatctacttcgactac

SEQ ID NO: 22739 - RNA, 66 nt, synthetic construct
  misc_feature 1..66: note = derived and/or modified sequence opt2 from anti-influenza_CDR
  source 1..66: mol_type = other RNA
gccaaggactcccagctccgctccctcctctacttcgagtggctctcccagggctacttcgacccc

SEQ ID NO: 22740 - RNA, 66 nt, synthetic construct
  misc_feature 1..66: note = derived and/or modified sequence opt2 from anti-influenza_CDR
  source 1..66: mol_type = other RNA
gccaaggactcccagctccgctccctcctctacttcgagtggctctcccagggctacttcgactac

SEQ ID NO: 22741 - RNA, 66 nt, synthetic construct
  misc_feature 1..66: note = derived and/or modified sequence opt2 from anti-influenza_CDR
  source 1..66: mol_type = other RNA
gccaaggactcccagctccgctccctcctctacttcgagtggctctcccagggctacttcgagccc

SEQ ID NO: 22742 - RNA, 66 nt, synthetic construct
  misc_feature 1..66: note = derived and/or modified sequence opt2 from anti-influenza_CDR
  source 1..66: mol_type = other RNA
gccaaggagcgccccctccgcctcctccgctacttcgactggctctccggcggcgccaacgactac

SEQ ID NO: 22743 - RNA, 66 nt, synthetic construct
  misc_feature 1..66: note = derived and/or modified sequence opt2 from anti-influenza_CDR
  source 1..66: mol_type = other RNA
gcccgcgacgtccacaactacgacttcctcaccggctaccccctccacctctacggcatggacgtc

SEQ ID NO: 22744 - RNA, 66 nt, synthetic construct
  misc_feature 1..66: note = derived and/or modified sequence opt2 from anti-influenza_CDR
  source 1..66: mol_type = other RNA
gcccgcgacggccgcgagggctacttctacggctccggctccttctacaacctcaagggcctcaac

SEQ ID NO: 22745 - RNA, 66 nt, synthetic construct
  misc_feature 1..66: note = derived and/or modified sequence opt2 from anti-influenza_CDR
  source 1..66: mol_type = other RNA
tccaccgaccgcggccacgtcctccgctacttcggctggatgctccccggcgacgccttcgacgtc

SEQ ID NO: 22746 - RNA, 66 nt, synthetic construct
  misc_feature 1..66: note = derived and/or modified sequence opt2 from anti-influenza_CDR
  source 1..66: mol_type = other RNA
ctcaactactacgaccgctccggctaccactcccccgacggcccctccaacaactggttcgacccc

SEQ ID NO: 22747 - RNA, 66 nt, synthetic construct
  misc_feature 1..66: note = derived and/or modified sequence opt2 from anti-influenza_CDR
  source 1..66: mol_type = other RNA
gcccgcgtcccccgcgaccgcctcctcaccctctactacgagtcctccacctacggcttcgactac

SEQ ID NO: 22748 - RNA, 66 nt, synthetic construct
  misc_feature 1..66: note = derived and/or modified sequence opt2 from anti-influenza_CDR
  source 1..66: mol_type = other RNA
gcccgcaagtggggccgcatgaccgtcttcggcgtcgccaccgaccagctctactacttcgactac

SEQ ID NO: 22749 - RNA, 66 nt, synthetic construct
  misc_feature 1..66: note = derived and/or modified sequence opt2 from anti-influenza_CDR
  source 1..66: mol_type = other RNA
gccaccgacatcgtcgtcgagcgcgacgcctccctcggcggcttcaactcctacggcatggacgtc

SEQ ID NO: 22750 - RNA, 69 nt, synthetic construct
  misc_feature 1..69: note = derived and/or modified sequence opt2 from anti-influenza_CDR
  source 1..69: mol_type = other RNA
gcccgcaacctccccgacatcgccgtcgtcaccgccgtccaggacgccacccccgtctggttcgacccc

SEQ ID NO: 22751 - RNA, 69 nt, synthetic construct
  misc_feature 1..69: note = derived and/or modified sequence opt2 from anti-influenza_CDR
  source 1..69: mol_type = other RNA
gacggcccctactccgacgacttccgctccggctacgccgcccgctaccgctacttcggcatggacgtc

SEQ ID NO: 22752 - RNA, 72 nt, synthetic construct
  misc_feature 1..72: note = derived and/or modified sequence opt2 from anti-influenza_CDR
  source 1..72: mol_type = other RNA
ggccgcgagctcctccgcctccagcacttcctcaccgactcccagtccgagcgccgcgactgcttcgacccc

SEQ ID NO: 22753 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacgagtggggctgccgctgcaacgactcctccgac

SEQ ID NO: 22754 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccaccaagaacgagtgggagtgccgctgcaacgactcctccgac

SEQ ID NO: 22755 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtgggagtgccgctgcaacgactcctccgac

SEQ ID NO: 22756 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacggctgggagtgcaagtgcaacgactcctccgac

SEQ ID NO: 22757 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgctccgagtggggctgccgctgcaacgactcctccgac

SEQ ID NO: 22758 - RNA, 72 nt, synthetic construct
  misc_feature 1..72: note = derived and/or modified sequence opt2 from anti-influenza_CDR
  source 1..72: mol_type = other RNA
atgtccttcctccccgaggtcgagacccccatccgcaacgagtggggctgccgctgcaacgactcctccgac

SEQ ID NO: 22759 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtggggctgccgctgcaacgactcctccaac

SEQ ID NO: 22760 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaaggagtggggctgccgctgcaacgactcctccgac

SEQ ID NO: 22761 - RNA, 72 nt, synthetic construct
  misc_feature 1..72: note = derived and/or modified sequence opt2 from anti-influenza_CDR
  source 1..72: mol_type = other RNA
atgtccttcctcaccgaggtcgagacccccatccgcaacgagtggggctgccgctgcaacgactcctccgac

SEQ ID NO: 22762 - RNA, 72 nt, synthetic construct
  misc_feature 1..72: note = derived and/or modified sequence opt2 from anti-influenza_CDR
  source 1..72: mol_type = other RNA
atgtccctccccaccgaggtcgagacccccatccgctccgagtggggctgccgctgcaacgactcctccgac

SEQ ID NO: 22763 - RNA, 72 nt, synthetic construct
  misc_feature 1..72: note = derived and/or modified sequence opt2 from anti-influenza_CDR
  source 1..72: mol_type = other RNA
atgtccctcctccccgaggtcgagacccccatccgcaacgagtggggctgccgctgcaacgactcctccgac

SEQ ID NO: 22764 - RNA, 72 nt, synthetic construct
  misc_feature 1..72: note = derived and/or modified sequence opt2 from anti-influenza_CDR
  source 1..72: mol_type = other RNA
atgtccctcctccccgaggtcgagacccccatccgcaacggctggggctgccgctgcaacgactcctccgac

SEQ ID NO: 22765 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacggctgggagtgccgctgctccggctcctccgac

SEQ ID NO: 22766 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtgggagtaccgctgcaacgactcctccgac

SEQ ID NO: 22767 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtgggagtaccgctgctccgactcctccgac

SEQ ID NO: 22768 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacggctgggagtgccgctactccgactcctccgac

SEQ ID NO: 22769 - RNA, 72 nt, synthetic construct
  misc_feature 1..72: note = derived and/or modified sequence opt2 from anti-influenza_CDR
  source 1..72: mol_type = other RNA
atgtccttcctcaccgaggtcgagaccctcacccgcaacggctgggagtgccgctgctccgactcctccgac

SEQ ID NO: 22770 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagaccctcacccgcaacggctgggagtgcaagtgccgcgactcctccgac

SEQ ID NO: 22771 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtggggctgccgctgcaacgactcctccgac

SEQ ID NO: 22772 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgctccgagtggggctgccgctgcaacgactccggcgac

SEQ ID NO: 22773 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtgggagtgccgctgcaacggctcctccgac

SEQ ID NO: 22774 - RNA, 72 nt, synthetic construct
  misc_feature 1..72: note = derived and/or modified sequence opt2 from anti-influenza_CDR
  source 1..72: mol_type = other RNA
atgtccctccccaccgaggtcgagacccccatccgcaacgagtggggctgccgctgcaacgactcctccgac

SEQ ID NO: 22775 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtggggctgccgctgcaacggctcctccgac

SEQ ID NO: 22776 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgacaccctcacccgcaacggctggggctgccgctgctccgactcctccgac

SEQ ID NO: 22777 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagaccctcaccaagaacggctggggctgccgctgctccgactcctccgac

SEQ ID NO: 22778 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacggctgggagtgcaagtgctccgactcctccgac

SEQ ID NO: 22779 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccacacccgcaacggctgggagtgcaagtgctccgactcctccgac

SEQ ID NO: 22780 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcaagacccccacccgcaacggctgggagtgcaagtgctccgactcctccgac

SEQ ID NO: 22781 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagaccctcacccgcaacggctggggctgccgctgctccgactcctccgac

SEQ ID NO: 22782 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcgacggctgggagtgcaagtgctccgactcctccgac

SEQ ID NO: 22783 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacggctggggctgccgctgctccgactcctccgac

SEQ ID NO: 22784 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacggctgggagtgcaagtgcaacgactcctccgac

SEQ ID NO: 22785 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagaccctcacccgcaacggctgggagtgcaagtgctccgactcctccgac

SEQ ID NO: 22786 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaacgagtggggctgcaagtgcaacgactcctccgac

SEQ ID NO: 22787 - RNA, 72 nt, synthetic construct
  misc_feature 1..72: note = derived and/or modified sequence opt2 from anti-influenza_CDR
  source 1..72: mol_type = other RNA
atgtccttcctcaccgaggtcgagacccccatccgcaacgagtggggctgccgctgcaacggctcctccgac

SEQ ID NO: 22788 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacggctgggagtgccgctgcaacgactcctccgac

SEQ ID NO: 22789 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccatccgcaagggctgggagtgcaactgctccgactcctccgac

SEQ ID NO: 22790 - RNA, 72 nt, synthetic construct
  misc_feature 1..72: note = derived and/or modified sequence opt2 from anti-influenza_CDR
  source 1..72: mol_type = other RNA
atgtccctcctcaccgaggtcgagacccccacccgcaacgagtgggagtgccgctgctccgactcctccgac

SEQ ID NO: 22791 - RNA, 72 nt, synthetic construct
  misc_feature 1..72: note = derived and/or modified sequence opt2 from anti-influenza_CDR
  source 1..72: mol_type = other RNA
atgtccctcctcaccggcgtcgagacccacacccgcaacggctggggctgcaagtgctccgactcctccgac

SEQ ID NO: 22792 - RNA, 72 nt, synthetic construct
  misc_feature 1..72: note = derived and/or modified sequence opt2 from anti-influenza_CDR
  source 1..72: mol_type = other RNA
atgtccctcctccccgaggtcgagacccacacccgcaacggctggggctgccgctgctccgactcctccgac

SEQ ID NO: 22793 - RNA, 72 nt, synthetic construct
  misc_feature 1..72: note = derived and/or modified sequence opt2 from anti-influenza_CDR
  source 1..72: mol_type = other RNA
accgacggcccctactccgacgacttccgctccggctacgccgcccgctaccgctacttcggcatggacgtc

SEQ ID NO: 22794 - RNA, 75 nt, synthetic construct
  misc_feature 1..75: note = derived and/or modified sequence opt2 from anti-influenza_CDR
  source 1..75: mol_type = other RNA
gccaagcacatgtccctccagcaggtcgtctccgccggctgggagcgcgccgacctcgtcggcgacgccttcgac

SEQ ID NO: 22795 - RNA, 75 nt, synthetic construct
  misc_feature 1..75: note = derived and/or modified sequence opt2 from anti-influenza_CDR
  source 1..75: mol_type = other RNA
gccaagcacctctccatgcagcaggtcgtctccgccggctgggagcgcgccgacctcgtcggcgacgccttcgac

SEQ ID NO: 22796 - RNA, 75 nt, synthetic construct
  misc_feature 1..75: note = derived and/or modified sequence opt2 from anti-influenza_CDR
  source 1..75: mol_type = other RNA
gccaagcacgcctccctccagcaggtcgtctccgccggctgggagcgcgccgacctcgtcggcgacgccttcgac

SEQ ID NO: 22797 - RNA, 75 nt, synthetic construct
  misc_feature 1..75: note = derived and/or modified sequence opt2 from anti-influenza_CDR
  source 1..75: mol_type = other RNA
gccaagcactcctccctccagcaggtcgtctccgccggctgggagcgcgccgacctcgtcggcgacgccttcgac

SEQ ID NO: 22798 - RNA, 75 nt, synthetic construct
  misc_feature 1..75: note = derived and/or modified sequence opt2 from anti-influenza_CDR
  source 1..75: mol_type = other RNA
gccaagcacctctccctccagcaggtcgtctccgccggctgggagcgcgccgacctcgtcggcgacgccttcgac

SEQ ID NO: 22799 - RNA, 75 nt, synthetic construct
  misc_feature 1..75: note = derived and/or modified sequence opt2 from anti-influenza_CDR
  source 1..75: mol_type = other RNA
gccaagcacatgtccatgcagcaggtcgtctccgccggctgggagcgcgccgacctcgtcggcgacgccttcgac

SEQ ID NO: 22800 - RNA, 75 nt, synthetic construct
  misc_feature 1..75: note = derived and/or modified sequence opt2 from anti-influenza_CDR
  source 1..75: mol_type = other RNA
gcccgcggccccgagacctactactacgacaagaccaactggctcaactcccaccccgacgagtacttccagcac

SEQ ID NO: 22801 - RNA, 75 nt, synthetic construct
  misc_feature 1..75: note = derived and/or modified sequence opt2 from anti-influenza_CDR
  source 1..75: mol_type = other RNA
accaccgacggcccctactccgacgacttccgctccggctacgccgcccgctaccgctacttcggcatggacgtc

SEQ ID NO: 22802 - RNA, 75 nt, synthetic construct
  misc_feature 1..75: note = derived and/or modified sequence opt2 from anti-influenza_CDR
  source 1..75: mol_type = other RNA
accgacggcccctactccgacgacttccgctccggctacgccgcccgctaccgctacttcggcatggacgtctgg

SEQ ID NO: 22803 - RNA, 78 nt, synthetic construct
  misc_feature 1..78: note = derived and/or modified sequence opt2 from anti-influenza_CDR
  source 1..78: mol_type = other RNA
gacatccagatgacccagtccccctcctccctctccgcctccgtcggcgaccgcgtcaccatcacctgccgctcctcc

SEQ ID NO: 22804 - RNA, 78 nt, synthetic construct
  misc_feature 1..78: note = derived and/or modified sequence opt2 from anti-influenza_CDR
  source 1..78: mol_type = other RNA
gccaccggccgcgccgccaccggctccgcctcctgcaccggcggcggcacctactggacctactgcacctgcaccacc

SEQ ID NO: 22805 - RNA, 81 nt, synthetic construct
  misc_feature 1..81: note = derived and/or modified sequence opt2 from anti-influenza_CDR
  source 1..81: mol_type = other RNA
ggctacatccccgaggccccccgcgacggccaggcctacgtccgcaaggacggcgagtgggtcctcctctccaccttcctc

SEQ ID NO: 22806 - RNA, 90 nt, synthetic construct
  misc_feature 1..90: note = derived and/or modified sequence opt2 from anti-influenza_CDR
  source 1..90: mol_type = other RNA
caggtccagctcctcgagaccggcggcggcctcgtcaagcccggccagtccctcaagctctcctgcgccgcctccggcttcaccttcacc

SEQ ID NO: 22807 - RNA, 96 nt, synthetic construct
  misc_feature 1..96: note = derived and/or modified sequence opt2 from anti-influenza_CDR
  source 1..96: mol_type = other RNA
cgcttcaccatctcccgcgacaactccaagaacaccctctacctccagatgaactccctccgcgccgaggacaccgccgtctactactgcgccaag

SEQ ID NO: 22808 - RNA, 96 nt, synthetic construct
  misc_feature 1..96: note = derived and/or modified sequence opt2 from anti-influenza_CDR
  source 1..96: mol_type = other RNA
ggcgtcccctcccgcttctccggctccggctccggcaccgacttcaccctcaccatctcctccctccagcccgaggacttcgccacctactactgc

SEQ ID NO: 22809 - RNA, 15 nt, synthetic construct
  misc_feature 1..15: note = derived and/or modified sequence opt2 from anti-OX40_HeavyChain_CDR1
  source 1..15: mol_type = other RNA
tcctactccatgaac

SEQ ID NO: 22810 - RNA, 15 nt, synthetic construct
  misc_feature 1..15: note = derived and/or modified sequence opt2 from anti-OX40_HeavyChain_CDR1
  source 1..15: mol_type = other RNA
gactacgccatgcac

SEQ ID NO: 22811 - RNA, 15 nt, synthetic construct
  misc_feature 1..15: note = derived and/or modified sequence opt2 from anti-OX40_HeavyChain_CDR1
  source 1..15: mol_type = other RNA
gactcctacatgtcc

SEQ ID NO: 22812 - RNA, 15 nt, synthetic construct
  misc_feature 1..15: note = derived and/or modified sequence opt2 from anti-OX40_HeavyChain_CDR1
  source 1..15: mol_type = other RNA
gacgcctacatgtcc

SEQ ID NO: 22813 - RNA, 15 nt, synthetic construct
  misc_feature 1..15: note = derived and/or modified sequence opt2 from anti-OX40_HeavyChain_CDR1
  source 1..15: mol_type = other RNA
gagtcctacatgtcc

SEQ ID NO: 22814 - RNA, 15 nt, synthetic construct
  misc_feature 1..15: note = derived and/or modified sequence opt2 from anti-OX40_HeavyChain_CDR1
  source 1..15: mol_type = other RNA
tccggctactggaac

SEQ ID NO: 22815 - RNA, 21 nt, synthetic construct
  misc_feature 1..21: note = derived and/or modified sequence opt2 from anti-OX40_LightChain_CDR2
  source 1..21: mol_type = other RNA
tacacctcccgcctccactcc

SEQ ID NO: 22816 - RNA, 21 nt, synthetic construct
  misc_feature 1..21: note = derived and/or modified sequence opt2 from anti-OX40_LightChain_CDR2
  source 1..21: mol_type = other RNA
gccgcctcctccctccagtcc

SEQ ID NO: 22817 - RNA, 21 nt, synthetic construct
  misc_feature 1..21: note = derived and/or modified sequence opt2 from anti-OX40_LightChain_CDR2
  source 1..21: mol_type = other RNA
gacgcctccaaccgcgccacc

SEQ ID NO: 22818 - RNA, 21 nt, synthetic construct
  misc_feature 1..21: note = derived and/or modified sequence opt2 from anti-OX40_LightChain_CDR2
  source 1..21: mol_type = other RNA
tacacctcccgcctccgctcc

SEQ ID NO: 22819 - RNA, 24 nt, synthetic construct
  misc_feature 1..24: note = derived and/or modified sequence opt2 from anti-OX40_LightChain_CDR3
  source 1..24: mol_type = other RNA
cagcagcgctccaactggcccacc

SEQ ID NO: 22820 - RNA, 24 nt, synthetic construct
  misc_feature 1..24: note = derived and/or modified sequence opt2 from anti-OX40_HeavyChain_CDR3
  source 1..24: mol_type = other RNA
gccccccgctggtacttctccgtc

SEQ ID NO: 22821 - RNA, 24 nt, synthetic construct
  misc_feature 1..24: note = derived and/or modified sequence opt2 from anti-OX40_HeavyChain_CDR3
  source 1..24: mol_type = other RNA
gccccccgctggtacttctccgcc

SEQ ID NO: 22822 - RNA, 24 nt, synthetic construct
  misc_feature 1..24: note = derived and/or modified sequence opt2 from anti-OX40_HeavyChain_CDR3
  source 1..24: mol_type = other RNA
gccccccgctggtacttcgccgtc

SEQ ID NO: 22823 - RNA, 27 nt, synthetic construct
  misc_feature 1..27: note = derived and/or modified sequence opt2 from anti-OX40_LightChain_CDR3
  source 1..27: mol_type = other RNA
cagcagggcaacaccctcccctggacc

SEQ ID NO: 22824 - RNA, 27 nt, synthetic construct
  misc_feature 1..27: note = derived and/or modified sequence opt2 from anti-OX40_HeavyChain_CDR3
  source 1..27: mol_type = other RNA
gagtccggctggtacctcttcgactac

SEQ ID NO: 22825 - RNA, 27 nt, synthetic construct
  misc_feature 1..27: note = derived and/or modified sequence opt2 from anti-OX40_LightChain_CDR3
  source 1..27: mol_type = other RNA
cagcagtacaactcctacccccccacc

SEQ ID NO: 22826 - RNA, 27 nt, synthetic construct
  misc_feature 1..27: note = derived and/or modified sequence opt2 from anti-OX40_LightChain_CDR3
  source 1..27: mol_type = other RNA
cagcagggccacaccctcccccccacc

SEQ ID NO: 22827 - RNA, 27 nt, synthetic construct
  misc_feature 1..27: note = derived and/or modified sequence opt2 from anti-OX40_LightChain_CDR3
  source 1..27: mol_type = other RNA
cagcagggccacaccctccccgccacc

SEQ ID NO: 22828 - RNA, 27 nt, synthetic construct
  misc_feature 1..27: note = derived and/or modified sequence opt2 from anti-OX40_LightChain_CDR3
  source 1..27: mol_type = other RNA
cagcagggccacaccgccccccccacc

SEQ ID NO: 22829 - RNA, 27 nt, synthetic construct
  misc_feature 1..27: note = derived and/or modified sequence opt2 from anti-OX40_LightChain_CDR3
  source 1..27: mol_type = other RNA
cagcagggcgccaccctcccccccacc

SEQ ID NO: 22830 - RNA, 27 nt, synthetic construct
  misc_feature 1..27: note = derived and/or modified sequence opt2 from anti-OX40_LightChain_CDR3
  source 1..27: mol_type = other RNA
cagcagggccacgccctcccccccacc

SEQ ID NO: 22831 - RNA, 27 nt, synthetic construct
  misc_feature 1..27: note = derived and/or modified sequence opt2 from anti-OX40_LightChain_CDR3
  source 1..27: mol_type = other RNA
cagcaggcccacaccctcccccccacc

SEQ ID NO: 22832 - RNA, 27 nt, synthetic construct
  misc_feature 1..27: note = derived and/or modified sequence opt2 from anti-OX40_LightChain_CDR3
  source 1..27: mol_type = other RNA
cagcagggccacaccctcgcccccacc

SEQ ID NO: 22833 - RNA, 27 nt, synthetic construct
  misc_feature 1..27: note = derived and/or modified sequence opt2 from anti-OX40_LightChain_CDR3
  source 1..27: mol_type = other RNA
caggccggccacaccctcccccccacc

SEQ ID NO: 22834 - RNA, 30 nt, synthetic construct
  misc_feature 1..30: note = derived and/or modified sequence opt2 from anti-OX40_HeavyChain_CDR1
  source 1..30: mol_type = other RNA
ggctacaccttcacctcctacgtcatgcac

SEQ ID NO: 22835 - RNA, 30 nt, synthetic construct
  misc_feature 1..30: note = derived and/or modified sequence opt2 from anti-OX40_HeavyChain_CDR3
  source 1..30: mol_type = other RNA
tactacggctcctccctctccatggactac

SEQ ID NO: 22836 - RNA, 33 nt, synthetic construct
  misc_feature 1..33: note = derived and/or modified sequence opt2 from anti-OX40_LightChain_CDR1
  source 1..33: mol_type = other RNA
cgcgcctcccaggacatctccaactacctcaac

SEQ ID NO: 22837 - RNA, 33 nt, synthetic construct
  misc_feature 1..33: note = derived and/or modified sequence opt2 from anti-OX40_LightChain_CDR1
  source 1..33: mol_type = other RNA
cgcgcctcccagggcatctcctcctggctcgcc

SEQ ID NO: 22838 - RNA, 33 nt, synthetic construct; identical to SEQ ID NO: 22356
  misc_feature 1..33: note = derived and/or modified sequence opt2 from anti-OX40_LightChain_CDR1
  source 1..33: mol_type = other RNA

SEQ ID NO: 22839 - RNA, 39 nt, synthetic construct
  misc_feature 1..39: note = derived and/or modified sequence opt2 from anti-OX40_HeavyChain_CDR3
  source 1..39: mol_type = other RNA
taccgctacgactacgacggcggccacgccatggactac

SEQ ID NO: 22840 - RNA, 39 nt, synthetic construct; identical to SEQ ID NO: 15198
  misc_feature 1..39: note = derived and/or modified sequence opt2 from anti-OX40_HeavyChain_CDR3
  source 1..39: mol_type = other RNA

SEQ ID NO: 22841 - RNA, 39 nt, synthetic construct
  misc_feature 1..39: note = derived and/or modified sequence opt2 from anti-OX40_HeavyChain_CDR3
  source 1..39: mol_type = other RNA
tacaagtacgactacgacggcggccacgccatggactac

SEQ ID NO: 22842 - RNA, 45 nt, synthetic construct
  misc_feature 1..45: note = derived and/or modified sequence opt2 from anti-OX40_HeavyChain_CDR3
  source 1..45: mol_type = other RNA
gaccagtccaccgccgactactacttctactacggcatggacgtc

SEQ ID NO: 22843 - RNA, 48 nt, synthetic construct
  misc_feature 1..48: note = derived and/or modified sequence opt2 from anti-OX40_HeavyChain_CDR2
  source 1..48: mol_type = other RNA
tacatctcctacaacggcatcacctaccacaacccctccctcaagtcc

SEQ ID NO: 22844 - RNA, 48 nt, synthetic construct
  misc_feature 1..48: note = derived and/or modified sequence opt2 from anti-OX40_HeavyChain_CDR2
  source 1..48: mol_type = other RNA
tacatctcctacaacgccatcacctaccacaacccctccctcaagtcc

SEQ ID NO: 22845 - RNA, 48 nt, synthetic construct
  misc_feature 1..48: note = derived and/or modified sequence opt2 from anti-OX40_HeavyChain_CDR2
  source 1..48: mol_type = other RNA
tacatctcctactccggcatcacctaccacaacccctccctcaagtcc

SEQ ID NO: 22846 - RNA, 51 nt, synthetic construct
  misc_feature 1..51: note = derived and/or modified sequence opt2 from anti-OX40_HeavyChain_CDR2
  source 1..51: mol_type = other RNA
tacatcaacccctacaacgacggcaccaagtacaacgagaagttcaagggc

SEQ ID NO: 22847 - RNA, 51 nt, synthetic construct
  misc_feature 1..51: note = derived and/or modified sequence opt2 from anti-OX40_HeavyChain_CDR2
  source 1..51: mol_type = other RNA
tacatctcctcctcctcctccaccatcgactacgccgactccgtcaagggc

SEQ ID NO: 22848 - RNA, 51 nt, synthetic construct
  misc_feature 1..51: note = derived and/or modified sequence opt2 from anti-OX40_HeavyChain_CDR2
  source 1..51: mol_type = other RNA
ggcatctcctggaactccggctccatcggctacgccgactccgtcaagggc

SEQ ID NO: 22849 - RNA, 51 nt, synthetic construct
  misc_feature 1..51: note = derived and/or modified sequence opt2 from anti-OX40_HeavyChain_CDR2
  source 1..51: mol_type = other RNA
gacatgtaccccgacaacggcgactcctcctacaaccagaagttccgcgag

SEQ ID NO: 22850 - RNA, 51 nt, synthetic construct
  misc_feature 1..51: note = derived and/or modified sequence opt2 from anti-OX40_HeavyChain_CDR2
  source 1..51: mol_type = other RNA
gacatgtaccccgacaacgccgactcctcctacaaccagaagttccgcgag

SEQ ID NO: 22851 - RNA, 51 nt, synthetic construct
  misc_feature 1..51: note = derived and/or modified sequence opt2 from anti-OX40_HeavyChain_CDR2
  source 1..51: mol_type = other RNA
gacatgtaccccgacaacgccgacgcctcctacaaccagaagttccgcgag

SEQ ID NO: 22852 - RNA, 51 nt, synthetic construct
  misc_feature 1..51: note = derived and/or modified sequence opt2 from anti-OX40_HeavyChain_CDR2
  source 1..51: mol_type = other RNA
gacatgtaccccgacaacggcgacgcctcctacaaccagaagttccgcgag

SEQ ID NO: 22853 - RNA, 51 nt, synthetic construct
  misc_feature 1..51: note = derived and/or modified sequence opt2 from anti-OX40_HeavyChain_CDR2
  source 1..51: mol_type = other RNA
gacatgtaccccgactccggcgactcctcctacaaccagaagttccgcgag

SEQ ID NO: 22854 - RNA, 51 nt, synthetic construct
  misc_feature 1..51: note = derived and/or modified sequence opt2 from anti-OX40_HeavyChain_CDR2
  source 1..51: mol_type = other RNA
gacatgtaccccgacaacggctcctcctcctacaaccagaagttccgcgag

SEQ ID NO: 22855 - RNA, 309 nt, synthetic construct
  misc_feature 1..309: note = derived and/or modified sequence opt2 from Ig_LightChain_kappa_constant_domain
  source 1..309: mol_type = other RNA
accgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgc

SEQ ID NO: 22856 - RNA, 309 nt, synthetic construct
  misc_feature 1..309: note = derived and/or modified sequence opt2 from Ig_LightChain_kappa_constant_domain
  source 1..309: mol_type = other RNA
accgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctccaacaccctcaccctctccaaggccgactacgagaagcacaaggtctacgcctgcgaggtcacccaccagggcctctcctcccccgtcaccaagtccttcaaccgc

SEQ ID NO: 22857 - RNA, 312 nt, synthetic construct
  misc_feature 1..312: note = derived and/or modified sequence opt2 from Ig_LightChain_lambda_constant_domain
  source 1..312: mol_type = other RNA
cccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 22858 - RNA, 312 nt, synthetic construct
  misc_feature 1..312: note = derived and/or modified sequence opt2 from Ig_LightChain_lambda_constant_domain
  source 1..312: mol_type = other RNA
cccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccgccgagtgctcc

SEQ ID NO: 22859 - RNA, 312 nt, synthetic construct
  misc_feature 1..312: note = derived and/or modified sequence opt2 from Ig_LightChain_lambda_constant_domain
  source 1..312: mol_type = other RNA
cccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccaccgagtgctcc

SEQ ID NO: 22860 - RNA, 312 nt, synthetic construct
  misc_feature 1..312: note = derived and/or modified sequence opt2 from Ig_LightChain_lambda_constant_domain
  source 1..312: mol_type = other RNA
cccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccacaagtcctactcctgccaggtcacccacgagggctccaccgtcgagaagaccgtcgcccccgccgagtgctcc

SEQ ID NO: 22861 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtc

SEQ ID NO: 22862 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtc

SEQ ID NO: 22863 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggcc

SEQ ID NO: 22864 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtc

SEQ ID NO: 22865 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgcc

SEQ ID NO: 22866 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtc

SEQ ID NO: 22867 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggcc

SEQ ID NO: 22868 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtc

SEQ ID NO: 22869 - RNA, 270 nt, synthetic construct
  misc_feature 1..270: note = derived and/or modified sequence opt2 from IgG1_HeavyChain_CH1_constant_domain
  source 1..270: mol_type = other RNA
tccggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgcc

SEQ ID NO: 22870 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggcc

SEQ ID NO: 22871 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtc

SEQ ID NO: 22872 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcttccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgcc

SEQ ID NO: 22873 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtc

SEQ ID NO: 22874 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggcc

SEQ ID NO: 22875 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtc

SEQ ID NO: 22876 - RNA, 282 nt, synthetic construct
  misc_feature 1..282: note = derived and/or modified sequence opt2 from IgG1_HeavyChain_CH1_constant_domain
  source 1..282: mol_type = other RNA
tccgcctccaccaagggcccctccgtcctccccctcgccccctcctccaagtccacctccggcggcaccgccgccctcggctgcctcgtcaaggactacttccccgagcccgtcaccgtctcctggaactccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgcc

SEQ ID NO: 22877 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22878 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22879 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22880 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22881 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22882 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22883 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22884 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcctcggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22885 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22886 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22887 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22888 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22889 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22890 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22891 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22892 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgagctcgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22893 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22894 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22895 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22896 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22897 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22898 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22899 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22900 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccctcggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22901 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22902 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22903 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22904 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22905 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22906 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcgccccctccgtcttcctcttcccccccaagcccaaggacaccctcatgatctcccgcacccccgaggtcacctgcgtcgtcgtcgacgtctcccacgaggaccccgaggtcaagttcaacgtctacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22907 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22908 - RNA, 330 nt, synthetic construct
  misc_feature 1..330: note = derived and/or modified sequence opt2 from IgG1_HeavyChain_CH2_constant_domain
  source 1..330: mol_type = other RNA
gcccccgaggccgccggcgccccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacgcctccacctaccgcgtcgtctccgtcctcaccgtcctccaccaggactggctcaacggcaaggagtacaagtgcaaggtctccaacaaggccctccccgcccccatcgagaagaccatctccaaggccaag

SEQ ID NO: 22909 - RNA, 318 nt, synthetic construct
  misc_feature 1..318: note = derived and/or modified sequence opt2 from IgG1_HeavyChain_CH3_constant_domain
  source 1..318: mol_type = other RNA
ggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 22910 - RNA, 318 nt, synthetic construct
  misc_feature 1..318: note = derived and/or modified sequence opt2 from IgG1_HeavyChain_CH3_constant_domain
  source 1..318: mol_type = other RNA
ggccagccccgcgagccccaggtctacaccctccccccctcccgcgaggagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 22911 - RNA, 318 nt, synthetic construct
  misc_feature 1..318: note = derived and/or modified sequence opt2 from IgG1_HeavyChain_CH3_constant_domain
  source 1..318: mol_type = other RNA
ggccagccccgcgagccccaggtctacaccctccccccctcccgcgacgagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 22912 - RNA, 318 nt, synthetic construct
  misc_feature 1..318: note = derived and/or modified sequence opt2 from IgG1_HeavyChain_CH3_constant_domain
  source 1..318: mol_type = other RNA
ggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 22913 - RNA, 297 nt, synthetic construct
  misc_feature 1..297: note = derived and/or modified sequence opt2 from IgG2_HeavyChain_CH1_constant_domain
  source 1..297: mol_type = other RNA
tccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctccaacttcggcacccagacctacacctgcaacgtcgaccacaagccctccaacaccaaggtcgacaagaccgtc

SEQ ID NO: 22914 - RNA, 297 nt, synthetic construct
  misc_feature 1..297: note = derived and/or modified sequence opt2 from IgG2_HeavyChain_CH1_constant_domain
  source 1..297: mol_type = other RNA
tccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcacctcctccaacttcggcacccagacctacacctgcaacgtcgaccacaagccctccaacaccaaggtcgacaagaccgtc

SEQ ID NO: 22915 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaag

SEQ ID NO: 22916 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcctccatcgagaagaccatctccaagaccaag

SEQ ID NO: 22917 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcccccatcgagaagaccatctccaagaccaag

SEQ ID NO: 22918 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcgtcgaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcctccatcgagaagaccatctccaagaccaag

SEQ ID NO: 22919 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcatggaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcccccatcgagaagaccatctccaagaccaag

SEQ ID NO: 22920 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcatggaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctccccgcctccatcgagaagaccatctccaagaccaag

SEQ ID NO: 22921 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcatggaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcccccatcgagaagaccatctccaagaccaag

SEQ ID NO: 22922 - RNA, 327 nt, synthetic construct
  misc_feature 1..327: note = derived and/or modified sequence opt2 from IgG2_HeavyChain_CH2_constant_domain
  source 1..327: mol_type = other RNA
gccccccccgtcgccggcccctccgtcttcctcttcccccccaagcccaaggacaccctcatgatctcccgcacccccgaggtcacctgcgtcgtcgtcgacgtctcccacgaggaccccgaggtccagttcaactggtacgtcgacggcatggaggtccacaacgccaagaccaagccccgcgaggagcagttcaactccaccttccgcgtcgtctccgtcctcaccgtcgtccaccaggactggctcaacggcaaggagtacaagtgcaaggtctccaacaagggcctcccctcctccatcgagaagaccatctccaagaccaag

SEQ ID NO: 22923 - RNA, 318 nt, synthetic construct
  misc_feature 1..318: note = derived and/or modified sequence opt2 from IgG2_HeavyChain_CH3_constant_domain
  source 1..318: mol_type = other RNA
ggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccatgctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggc

SEQ ID NO: 22924 - RNA, 297 nt, synthetic construct
  misc_feature 1..297: note = derived and/or modified sequence opt2 from IgG4_HeavyChain_CH1_constant_domain
  source 1..297: mol_type = other RNA
tccgcctccaccaagggcccctccgtcttccccctcgccccctgctcccgctccacctccgagtccaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcaccaagacctacacctgcaacgtcgaccacaagccctccaacaccaaggtcgacaagcgcgtc

SEQ ID NO: 22925 - RNA, 330 nt, synthetic construct
  misc_feature 1..330: note = derived and/or modified sequence opt2 from IgG4_HeavyChain_CH2_constant_domain
  source 1..330: mol_type = other RNA
gcccccgagttcctcggcggcccctccgtcttcctcttcccccccaagcccaaggacaccctcatgatctcccgcacccccgaggtcacctgcgtcgtcgtcgacgtctcccaggaggaccccgaggtccagttcaactggtacgtcgacggcgtcgaggtccacaacgccaagaccaagccccgcgaggagcagttcaactccacctaccgcgtcgtctccgtcctcaccgtcctccaccaggactggctcaacggcaaggagtacaagtgcaaggtctccaacaagggcctcccctcctccatcgagaagaccatctccaaggccaag

SEQ ID NO: 22926 - RNA, 318 nt, synthetic construct
  misc_feature 1..318: note = derived and/or modified sequence opt2 from IgG4_HeavyChain_CH3_constant_domain
  source 1..318: mol_type = other RNA
ggccagccccgcgagccccaggtctacaccctccccccctcccaggaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactcccgcctcaccgtcgacaagtcccgctggcaggagggcaacgtcttctcctgctccgtcatgcacgaggccctccacaaccactacacccagaagtccctctccctctccctcggc

SEQ ID NO: 22927 - RNA, 1347 nt, synthetic construct
  misc_feature 1..1347: note = derived and/or modified sequence opt3 from AAB-003_gamma1-Chain
  source 1..1347: mol_type = other RNA
gaggtgcagctgctcgaaagcggcgggggacttgtccaacccggtggctccctgagattgtcttgcgccgcttcagggttcacctttagtaactacggaatgagctgggttaggcaggcacctggcaagggtttagagtgggtggcctccatccggtctgggggaggccgcacatattactcggacaatgtaaaaggccgattcactatttcacgtgataacagcaagaatacgctgtatctacagatgaacagtctcagagcggaagacaccgctgtgtactattgtgtcaggtacgatcactattccgggtctagcgactactggggacagggtacactggtgactgtttcctcagccagtaccaaaggcccaagcgtgtttccgcttgcaccctcttccaagtcaacaagcgggggaaccgccgctctgggctgcttggtcaaagattacttccctgagccagtgactgtaagttggaactctggtgcactcacatccggggttcatacctttcccgccgtgctgcaaagctcgggactgtattctctctcctcagtcgtgacggtgcctagtagctccttaggcactcagacctacatatgtaatgtcaatcacaagccatctaacacaaaggttgacaaaaaggtggaacccaaaagctgcgataagactcatacctgtcctccatgcccggctcccgaggccgcgggcgcaccttcagtattcctgtttccacccaaacctaaggacacacttatgatcagtcggaccccagaggtgacgtgtgtcgtggttgatgtgtcccacgaagaccccgaggtcaagttcaattggtatgtggatggggtagaagttcataacgccaaaactaagccgcgcgaggagcagtacaatagcacatatagagtggtctctgtgttgaccgtcctgcaccaggactggctaaacggaaaagaatacaagtgcaaagtgtcaaataaggctctccctgcccccattgagaaaactatcagtaaggcaaagggtcaaccaagggaacctcaggtttatacactgcccccaagccgggaggaaatgaccaaaaaccaggtgtcccttacgtgtctggtaaagggcttttacccctctgatattgctgtcgagtgggagtcgaatgggcagcctgaaaacaactacaaaaccacaccaccggtgttggacagcgacggatccttctttctctattcaaagctgactgttgataaaagtcgctggcaacagggcaatgtgttctcttgcagcgtcatgcacgaggccttacataaccactacacccagaagtccctgtcactcagccccggtaag

SEQ ID NO: 22928 - RNA, 1329 nt, synthetic construct
  misc_feature 1..1329: note = derived and/or modified sequence opt3 from Abagovomab_HeavyChain
  source 1..1329: mol_type = other RNA
caggtgaagctgcaagagagcggcgccgaactcgctagacccggggcatccgtcaaactttcttgcaaggcctcaggatacaccttcacaaactattggatgcagtgggttaaacagaggcctggtcagggcctggactggatcggggcgatttacccaggagatggcaatactcggtatacgcacaagtttaaaggtaaggctaccttgacagccgacaagagtagctccactgcatacatgcaattatcttcgctggcctcagaggatagcggggtgtattactgtgctcgcggagaaggcaactatgcatggttcgcctactggggccaggggaccacagtaaccgtgagttccgctaaaactacaccgccctctgtctaccctctagccccaggaagcgcggcacagaccaattccatggtgacgctcggttgcctggttaagggctattttcccgagcctgtgactgtcacctggaactcagggagtcttagctctggagtgcatacattcccagccgtactgcagtccgacttgtacactctctcaagcagtgttaccgtgccctcttccacatggcctagcgaaaccgtcacgtgtaatgtggctcacccagcctcgtctactaaagtggataagaaaatagtcccgcgagactgcggctgtaagccctgcatctgtacagttcctgaggtgtcctcagtatttattttcccacccaagcctaaagatgtgctgaccatcactctgacaccaaaggtgacctgcgtcgttgtggacattagtaaagatgaccccgaggtccaatttagctggttcgtggatgacgtagaagttcatacggcacagacccagccgcgtgaggaacagtttaactccacattcagatctgtgagcgagctccctatcatgcaccaagattggttaaatggtaaggagtttaaatgtagggtcaactcagctgccttccccgcgccaatagaaaagactatcagtaaaaccaaggggcggcctaaggcaccccaggtgtatacaattccaccccctaaagagcagatggccaaggacaaagtctccctgacttgcatgatcaccgactttttcccagaagatattacagtggagtggcaatggaatggacagccggctgaaaactacaagaatacccagcccatcatggacactgatggcagctatttcgtttactctaaacttaacgtgcagaagtcaaattgggaggccggcaacacgtttacatgtagtgtattgcatgaggggctgcacaatcaccataccgaaaagagcctatcccactctcctggaaaa

SEQ ID NO: 22929 - RNA, 642 nt, synthetic construct
  misc_feature 1..642: note = derived and/or modified sequence opt3 from Abagovomab_LightChain
  source 1..642: mol_type = other RNA
gacatcgagctgacccagagccccgcctccctctctgcttcagtgggcgaaacagtcactattacgtgccaagcaagtgagaacatatacagctatcttgcctggcaccagcagaagcaggggaaatcccctcaactgttggtttacaatgcgaagaccttagctggaggtgtgtcttcgagattctcaggcagcgggagtggaacacatttttccctgaaaatcaagtctctacagccagaagatttcggcatttattactgtcagcaccattatggtatcctcccgacttttgggggaggcaccaaactggagattaagagggccgacgcagcccccacagtaagcatcttccctccatcctcagaacagcttaccagtggcggggctagcgtggtctgctttctgaacaatttctaccccaaggatataaacgtgaaatggaagatcgacggatctgagcggcaaaatggtgttttgaactcctggactgatcaggactcaaaagatagcacatatagtatgtcttccaccctcacgctgactaaggacgagtacgaacgccacaatagctacacctgtgaggcaacacataaaacttcgacctctcctattgtgaagtcctttaaccgaaatgaatgc

SEQ ID NO: 22930 - RNA, 1350 nt, synthetic construct
  misc_feature 1..1350: note = derived and/or modified sequence opt3 from Abciximab_HeavyChain
  source 1..1350: mol_type = other RNA
gaggtgcagctgcaacagagcggcgccgaactcgtcaagcccggggcttccgttaaactttcttgcaccgcatcaggattcaacatcaaggacacatacgtgcactgggtaaaacagagacctgagcagggtctggaatggattggcaggatagatccagccaatgggtatactaagtacgacccgaaatttcaaggaaaggcgacgatcaccgctgatacaagtagcaacactgcctatttgcagttatcctctctgacctcggaggacacagcagtgtactattgtgtccggcccctatacgattattacgccatggactactggggccagggtacctcagtgactgttagcagtgctaagacaaccgcaccttccgtgtatccactcgcccccgtctgcggggatacgactggatctagcgtgaccctgggctgtcttgtaaaaggctacttccctgaaccagttacactgacttggaactccgggtcattgagtagcggagtgcatacctttcccgctgtcctccagtctgacctgtatacactgtcctcaagcgtgaccgtgacgagttctacttggccttcccaaagcattacatgcaatgtcgcccacccagcgtcgtctaccaaggttgataaaaagatcgagccgcgccccaaatcctgtgacaagactcatacatgccctccatgtcccgcacctgagctcttaggtggcccatcagtgttcctgtttcccccgaagcctaaagatacccttatgattagtcgaacgcccgaagtaacctgcgtggtcgtggacgttagccacgaggatccagaagtgaagttcaattggtacgtcgacggggtggaggtacataacgccaaaacaaagcctcgtgaggaacagtataattccacttacagagttgtgtctgtcttgaccgtgctgcaccaggactggctaaacggaaaagagtataagtgtaaagtcagcaataaggctctccccgccccaatcgaaaagacaatatcaaaagcaaagggccagcccagggagcctcaagtgtacactctgccaccgagtcgggatgaacttaccaaaaaccaggtttccctgacatgcttggtgaagggtttttaccccagcgacatcgctgtagagtgggagtctaatgggcagcctgaaaacaattataaaaccactccacccgtcctcgattcagacggaagtttctttctgtacagcaagttaacggtggataagtcccgctggcaacagggcaacgttttctcttgttcggtgatgcacgaggccctgcataatcactatacacagaaaagcctctccctttcacctggcaag

SEQ ID NO: 22931 - RNA, 642 nt, synthetic construct
  misc_feature 1..642: note = derived and/or modified sequence opt3 from Abciximab_LightChain
  source 1..642: mol_type = other RNA
gacatcctgatgacccagagcccctcctctatgtcagtgagtctcggcgatacagtcagcattacttgccacgcctcccaagggatatcttcgaacatcggatggcttcagcagaagcctggtaaatcattcatgggcctgatttactatgggacgaatttggttgacggagtgccaagcagatttagtggctccggttctggggctgattacagcttaaccatctcctcactggacagtgaggatttcgcagactattactgtgtacagtatgcccaactaccgtacacatttggaggcggcactaagctcgaaattaaaagggcggatgctgcccccaccgtgagcatcttccctccatcttccgagcagctgacatcagggggagcaagcgtcgtgtgctttcttaacaatttctatcccaaggacataaacgttaaatggaagatcgatggtagtgaacggcagaatggcgtgctgaactcttggaccgaccaggattccaaggacagcacttactcgatgtcttccacattgaccctcacgaaagatgagtacgaacgccataattcatatacttgtgaggccacccacaagacaagtactagccctattgtcaaatcctttaaccgaaatgagtgc

SEQ ID NO: 22932 - RNA, 1341 nt, synthetic construct
  misc_feature 1..1341: note = derived and/or modified sequence opt3 from Abituzumab_HeavyChain1
  source 1..1341: mol_type = other RNA
caggtgcaactgcagcagagcggcggggagctcgccaagcccggagcttccgtcaaagtttcttgcaaggcatcaggttacaccttcagtagcttttggatgcactgggtgagacaggcccctggccaagggcttgaatggatcggatatattaacccaaggtccggctacacagagtataatgaaatattccgggacaaagcgactatgacgaccgatacatctacttcgaccgcttacatggagctgagctcattgcgcagtgaagacacagccgtatattactgtgcatcctttttaggtcgaggggccatggattattggggacagggcaccactgtgacagtctctagcgcttccaccaagggcccgtcagtgttccccctggcaccttgcagtcgtagcacgtctgagtccactgccgctctagggtgtctcgttaaagactactttccagagcccgtgaccgtctcatggaacagcggagccctgacaagtggtgtgcatactttccctgcggtacttcagtcttccggcctgtacagcttgtcgtctgttgtgaccgtcccatcctcaaattttgggacacagacctatacgtgcaacgtggatcacaagcccagtaatactaaggtggacaaaacagtcgaacctaagagctccgataaaacccatacttgtccaccgtgccccgcacctccagttgccggaccctctgtgttcctctttcctccaaagcccaaagacacactgatgatcagcagaaccccggaggtaacgtgtgtggtcgtggatgtttcacacgaagaccctgaggtgcaattcaactggtacgtcgatggcgtggaggtacataatgctaagaccaagcccagggaggaacaggcccagagtacatttcgggttgtgtccgtcctgactgtggtccaccaggactggctcaacggtaaagaatataagtgcaaagtgagcaataaggggttaccagcacctattgagaaaaccatctctaagacaaaaggacaaccccgcgaaccacaggtttacactctgcccccttcaagagaggagatgaccaagaaccaggtgagtcttacatgtttggtaaagggcttctatccaagcgatattgctgtcgaatgggagtccaatggccaaccggaaaacaattacaaaaccactccccctatgctggactctgacgggtcgtttttcctatatagcaagctcacggtggataaatccaggtggcagcagggaaacgttttctcatgcagtgtgatgcacgaggccctgcataatcactacacacagaagtctcttagcctgtccccaggtaaa

SEQ ID NO: 22933 - RNA, 642 nt, synthetic construct
  misc_feature 1..642: note = derived and/or modified sequence opt3 from Abituzumab_LightChain1
  source 1..642: mol_type = other RNA
gacatccagatgacccaaagcccctcctctctgtcagccagtgtgggcgatagagtcacaattacttgcagggctagccaggacatatccaactacctcgcatggtatcagcagaagcctgggaaagccccaaaacttctgatctactatacgtctaagattcactcgggagttccgtcacggttcagcggtagtggctccgggaccgattacacatttactatctctagcttgcaacccgaggacattgcgacctattactgtcagcagggaaatacattcccttatacctttggccagggtactaaggtggaaatcaaacgcacagtagctgccccatccgtgttcatatttcccccttcagatgagcaattaaagagtgggaccgcaagcgtcgtgtgcctgctaaacaatttctacccacgagaagccaaggttcagtggaaagtggacaacgctctccagtctggaaattcccaggagtcagtcacggaacaagatagcaaggacagtacttactctctgtccagcacccttacactgtcgaaagcagattatgagaagcataaagtgtacgcctgtgaggtaactcaccagggcttgtcttcccccgttaccaagtcatttaaccgtggcgaatgc

SEQ ID NO: 22934 - RNA, 1332 nt, synthetic construct
  misc_feature 1..1332: note = derived and/or modified sequence opt3 from Abrilumab_HeavyChain1
  source 1..1332: mol_type = other RNA
caggtgcaactggtccagagcggcgccgaggttaagaaacccggggcttccgtgaaggtatcttgcaaagtgtcaggatacaccctcagtgaccttagcatccactgggtcagacaggcacctggtaagggcctggaatggatgggagggttcgatccacaggacggcgagacaatttatgcccaaaaatttcagggtagggtgactatgacggaagatacctccacagacactgcgtacatggagttgtcttcgttaaagtcagaagataccgctgtttattactgtgccacagggagcagttcctcttggttcgacccgtggggacagggcaccctggtgactgtcagctccgcatcaacaaagggccccagtgtgtttcctctagccccatgcagccggtctacctccgagtcaacggctgcactcgggtgtctggtaaaagattatttccccgagcctgttactgtgagctggaacagtggagcccttacctctggtgtccatacatttccagctgtgctgcagtccagcggcttgtactcgctctcttccgtggtcactgttccctcaagtaatttcgggacccaaacatatacctgcaacgtggaccacaagcctagcaatacgaaagtagataagactgtggaacgcaaatgttgcgtcgagtgtccaccgtgccccgcccctccagtggcgggaccctccgtttttctgttccctccaaagcccaaggacacactgatgatatctcgaaccccggaagtgacttgtgtcgtggtagatgttagccatgaggaccctgaggtgcagtttaactggtacgtcgatggcgtggaagtccacaatgcaaaaacaaagccccgtgaggaacagttcaactcaacctttagagtggttagtgtgctcacggtagtccatcaggactggttaaatggtaaagagtacaagtgcaaagtgtccaacaaggggctgccagcccctatcgagaaaaccattagcaagacaaagggacaacccagggaaccacaggtttatactcttcccccttctcgggaggaaatgaccaaaaatcaggtgtcattgacatgtctggtcaagggcttctacccaagtgacatcgctgtggagtgggaaagcaacggccaaccggagaataactataaaactacaccccctatgctagattccgacgggtcgtttttcctctactctaagctgaccgtagataaaagccgctggcagcagggaaatgtgttctcctgctcagttatgcacgaagcccttcacaaccattatacccagaagagtctgtctttgagcccaggtaag

SEQ ID NO: 22935 - RNA, 642 nt, synthetic construct
  misc_feature 1..642: note = derived and/or modified sequence opt3 from Abrilumab_LightChain1
  source 1..642: mol_type = other RNA
gacatccagatgacccaaagcccctcctctgtgtcagccagtgtcggcgatagagttacaattacttgcagggctagccaggggatatcctcttggctggcatggtaccagcagaaacctggaaaagccccaaagctccttatctatggtgcgtcgaacctggagtcaggcgtgccgagccggttcagtgggtccggatctggcacggactttaccttgacaattagctccttacaacccgaagatttcgctaattactattgtcagcaggccaactcatttccttggactttcggtcaggggaccaaagtagagatcaagcgcacagtggcagccccaagtgtctttatttttccccctagcgacgaacaactgaaatctggaaccgcttccgtggtttgcctactcaataacttctacccacgagaggcaaaggtgcagtggaaggtcgataatgccctgcagtcaggcaacagccaggaaagtgtgactgagcaagactctaaagattccacatatagcctttcgtctaccctgacgttgtccaaggctgactacgagaaacacaaggtatatgcctgtgaagttactcatcagggcctctcaagtcccgtgaccaagagcttcaatcgtggggagtgc

SEQ ID NO: 22936 - RNA, 639 nt, synthetic construct
  misc_feature 1..639: note = derived and/or modified sequence opt3 from Abrilumab_LightChain1_variant2
  source 1..639: mol_type = other RNA
cagatcgtgctgacccaaagccccgccattatgtccgcttctcctggcgagaaggtgacaataacttgctcagcaagtagctccgtttcttacatgaactggttccagcagaaaccagggacgtcgccgaagctctggatctattcaaccagcaatcttgccagtggagtgcccgcgagattttccggttctggcagcgggacatcctactcactgactattagtaggatggaagctgaggacgccgcaacctattactgtcagcaacggagctcttatcctaacacattcggaggcggtaccaaattggaaatcaagcgcgccgatgctgcaccaactgtatccatttttcccccttcaagcgagcagttaacaagtgggggagcctctgtggtctgcttcctgaataacttttacccaaaagacatcaatgtgaagtggaagatagatggctccgaacgacagaacggcgttctaaatagctggaccgaccaggattcgaaagactctacgtattccatgtcaagtactctcaccctgacaaaggatgagtacgagcgtcacaacagctacacttgtgaagctacccataaaacatccacctctcccatcgtcaagagcttcaatagaaacgagtgc

SEQ ID NO: 22937 - RNA, 1347 nt, synthetic construct
  misc_feature 1..1347: note = derived and/or modified sequence opt3 from Actoxumab_HeavyChain1
  source 1..1347: mol_type = other RNA
gaggtgcagctggtccaaagcggcgccgaagttaagaaatccggggagtctctcaagatctcatgcaaaggaagtggttacagcttcacctcctattggattggctgggtgagacagatgcccgggaagggacttgaatggatgggcatattttaccctggtgactcttcgacaaggtattcacccagcttccaggggcaggtaactatcagtgctgataaatccgtgaacacggcatacctgcaatggtctagcttgaaggcctccgacaccgcgatgtattactgtgctcggcgccgaaattggggaaacgcctttgatatttggggccagggcacaatggtcactgtgtcaagtgcaagcaccaaggggccgtctgttttccccttagccccttcctcaaaaagcacaagtggaggtaccgctgcactgggctgcctagtgaaggactattttccagagcccgtcactgtgtcttggaactccggggccctcacaagcggagtacacaccttccctgctgttctgcagtcgtctggcctttactccctgtcaagtgtggtcacggtgccaagctcctctttgggtactcagacctacatctgtaatgtgaatcataaacccagcaacacaaaggtcgataaacgtgttgaacctaagtcatgcgacaagactcacacctgtccaccgtgccccgcccctgagctcctcgggggaccaagtgtgtttctgttcccacctaaaccaaaggatacactgatgatttccagaacccccgaggtaacgtgtgtggtcgtggacgttagccatgaagatccggaggtgaaatttaattggtatgtcgacggcgtggaagtacacaacgcgaagactaaacctagggaggagcaatacaattctacatatcgggttgtgtcagtcttaaccgtgctgcatcaggattggcttaacggcaaggaatacaaatgcaaggtcagtaataaggcattgcccgccccaatcgagaaaactataagcaaggctaaagggcagcctcgcgaaccccaggtgtatacactgccaccctccagagaggaaatgaccaagaaccaagtttctctaacgtgtctcgtgaaaggattctacccttcggacatcgccgtagagtgggagagcaatggtcagccagaaaacaattataagaccacaccgcccgtcctggattccgacggctcatttttcctttacagtaagctgactgtggacaaatctaggtggcagcaagggaacgtttttagctgctccgtgatgcacgaggcattgcacaaccattacacccagaagtcactcagcctgtctcctggaaaa

SEQ ID NO: 22938 - RNA, 645 nt, synthetic construct
  misc_feature 1..645: note = derived and/or modified sequence opt3 from Actoxumab_LightChain1
  source 1..645: mol_type = other RNA
gagatcgtgctgacccagagccccggcacactctccctttctcctggggaaagagccactctgtcatgcagggctagtcaaagcgtctcctcttcgtacttggcatggtatcagcagaaaccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaacctggacatttgggcagggaaccaaagtggagattaagagaactgtagcagccccaagtgtgttcatctttccccctagcgatgaacagctgaaatctggcacagcttccgtcgtgtgccttctgaacaatttctacccaagggaggcaaaggttcaatggaaagtggacaacgccttgcagtcaggcaatagccaggagagtgtcaccgaacaggattctaaggactccacgtatagcctctcgtctactctgaccctgtccaaggctgattacgagaaacacaaggtgtacgcctgtgaagtaacacatcaagggctctcaagtcccgttactaagagctttaaccggggagagtgc

SEQ ID NO: 22939 - RNA, 672 nt, synthetic construct
  misc_feature 1..672: note = derived and/or modified sequence opt3 from Adalimumab_HeavyChain
  source 1..672: mol_type = other RNA
gaggtgcagctggtcgaaagcggcgggggactcgttcaacccggtagatcccttaggctgtcttgcgccgcttcaggcttcacctttgacgattacgcaatgcactgggtgcggcaggcccctgggaagggattggagtgggtaagtgcgatcacatggaacagcggccatattgactatgctgattccgtggaaggtcgcttcactatatctcgagacaatgccaaaaactcgttatacctgcagatgaactcactacgtgcagaggatacggccgtctattactgtgctaaggtgagctatctcagtaccgcatcctctctggactactgggggcagggaacacttgttactgtgagctccgcctcaaccaaaggcccaagtgtctttccgctggctcccagctctaagtccacatcaggcgggaccgccgcgttgggatgcctcgtgaaagattatttccctgaaccagtaactgttagctggaatagtggtgcactgacatctggcgtgcacacctttcccgccgtcctgcaatccagcgggctctactcgttatcttccgtggtgacggtcccttcaagtagcctgggaactcagacctacatctgtaatgttaaccataagccatccaatacaaaggtggacaaaaaggtagagcccaaatcttgc

SEQ ID NO: 22940 - RNA, 642 nt, synthetic construct
  misc_feature 1..642: note = derived and/or modified sequence opt3 from Adalimumab_LightChain
  source 1..642: mol_type = other RNA
gacatccagatgacccaaagcccctcctctctgtcagccagtgtgggcgatagagtcacaattacttgcagggctagccaggggatacggaactacctcgcatggtatcagcagaagcctggaaaagccccaaaacttctgatctacgcggcttccacgttgcaatctggtgttccgtcgcgcttctcaggcagcgggagtggaaccgactttacattaactatttcctctctgcagcccgaggatgtggccacctattactgtcagcgatataatcgtgcaccttacacattcggccagggtaccaaggtagaaatcaagagaactgtggccgctccaagcgtctttatttttcccccttccgacgagcaactaaaatcagggacagcaagtgtggtttgcctcctgaacaatttctatccaagggaagccaaggtgcagtggaaggtcgataacgcccttcagagcggaaattctcaggagtccgtgaccgaacaagactcaaaagatagcacgtacagtctgtcttccactttgaccctcagcaaggctgactacgagaaacacaaggtatatgcgtgtgaggttacacatcagggcctgtcgtctcccgtgactaaatccttcaaccggggcgaatgc

SEQ ID NO: 22941 - RNA, 1359 nt, synthetic construct
  misc_feature 1..1359: note = derived and/or modified sequence opt3 from Aducanumab_HeavyChain1
  source 1..1359: mol_type = other RNA
caggtgcaactggtcgagagcggcgggggagttgtgcagcccggtagatccctcaggctttcttgcgccgcttcaggcttcgcatttagtagctacgggatgcactgggtacggcaggcccctggaaagggcctggaatgggtggcggtcatctggttcgacggtaccaaaaagtattacacagattccgtgaaagggcgctttactatttctcgagacaactcgaagaatacgttgtatttacagatgaacaccctgcgtgctgaggatacagccgtttactattgtgcaagagacaggggaataggcgcccggcgcggcccatactatatggatgtgtgggggaaaggaactaccgtcacagtgtcaagcgctagtaccaagggtccgtccgtattccccctagcaccttctagcaagtccacttcaggcgggacagccgctctcggatgcctggttaaagactactttccagaacccgtgaccgtcagttggaatagcggcgcccttacgtctggtgtgcatactttccctgcggtgctgcaatcctcagggttgtacagcctcagttctgtcgttaccgtgccatccagctcgctgggaacacagacttatatctgtaacgtaaatcacaagccctctaacaccaaagtggataagagagtcgagcctaaatcctgcgacaagacacatacctgtccaccgtgccccgcacctgaactgctcggcggcccatcagtgtttttatttccccctaagccaaaagatacgctgatgattagtaggactcccgaggttacatgtgtggtcgtggacgtaagccacgaggatccggaagttaagtttaattggtacgtggacggggtcgaggtgcataacgccaaaaccaagcctcgggaggaacagtataattccacttaccgcgtcgtgtctgttcttacagtgttgcaccaggattggctgaacggaaaagagtataagtgcaaagtaagcaataaggctctacccgccccaatcgaaaagaccatttcaaaagcaaagggtcaacctcgagagccccaggtctacacgctcccacccagtagagaagagatgaccaaaaaccaggtgtccctgacatgtcttgttaagggcttctatcctagcgacatcgctgtggaatgggagtctaatgggcagccagagaacaattacaaaactaccccgcccgtcctggactcagatggaagtttcttcttgtacagcaagctcacagtggacaagtccaggtggcaacagggcaacgtattttcttgctcggtgatgcacgaagccctgcataaccactatactcagaaatccttaagcctgtcacctggt

SEQ ID NO: 22942 - RNA, 642 nt, synthetic construct
  misc_feature 1..642: note = derived and/or modified sequence opt3 from Aducanumab_LightChain1
  source 1..642: mol_type = other RNA
gacatccagatgacccaaagcccctcctctctgtcagccagtgtgggcgatagagtcacaattacttgcagggctagccagtccatatcttcgtacctcaactggtatcagcagaagcctgggaaagcaccaaaacttctgatctacgccgcgagctcattgcaaagtggagttccgtcccggttctctggtagcggctccgggacggactttaccttaacaatttcaagtctgcagcccgaggatttcgctacttattactgtcagcagagctattctacccctctaacatttggaggcggtaccaaagtggaaatcaagcgcactgtagccgcaccatccgtgttcatttttcccccttcagacgagcaactcaaaagcgggacagccagtgtcgtgtgcctgcttaataacttctacccacgagaagctaaggttcagtggaaggtggataatgcactgcagtctggaaactcccaggagagcgtcaccgaacaagactcgaaagattctacgtattccttgtcaagtactctcaccctgagcaaggccgactacgagaaacacaaggtgtacgcttgtgaggtaacacatcagggcctgtcctctcccgttactaagagctttaatcgtggcgaatgc

SEQ ID NO: 22943 - RNA, 1359 nt, synthetic construct
  misc_feature 1..1359: note = derived and/or modified sequence opt3 from Afasevikumab_HeavyChain1
  source 1..1359: mol_type = other RNA
gaggtgcagctggtcgaaagcggcgggggactcgttcaacccggtagatcccttaggctgtcttgcgccgcttcaggcttcacctttgacgattacgcaatgcactgggtgcggcaggcccctgggaagggattggagtgggtaagtggcatcaactggagctccggtgggattggatatgcggactctgtgaaaggccgcttcacaatatcgcgagataatgctaagaactcattatacctgcagatgaatagcctacgtgccgaagacactgcactctattactgtgccagagatatcggcgggtttggagagttctattggaactttggtctgtggggcagggggacgcttgtcaccgtgagttccgcttctacaaaaggaccaagcgttttcccgctggcaccctcctcaaagagtactagcggcggtaccgccgctttggggtgcctcgtgaaagactactttcctgaaccagtcacagtgtcttggaactccggagccctgacctcaggcgtacatactttccccgcggttctgcagagcagtggcctctattctttatccagcgtggtcacagtgccttcgtcttccctggggacccaaacgtacatttgtaatgtgaatcacaagccatcaaacactaaggtcgataaacgggttgagcccaagagttgcgacaaaacccatacatgtcctccatgcccggcacccgagcttttgggaggtcctagcgtgtttctgttcccacccaagcctaaagatactctaatgatctcccgcaccccagaagtaacatgtgtggtcgtggacgtttctcacgaggatcccgaagtgaagtttaattggtacgtcgacggcgtggaggtacataacgccaagaccaaaccgagagaggaacagtataatagcacgtacagggttgtgtcagtcctcactgtgctgcaccaggattggcttaacgggaaggagtataaatgcaaggtcagtaataaagctctgcctgcccccattgaaaagacaatctccaaagcaaagggacagccacgggagcctcaagtgtacaccttgcccccaagccgcgaagagatgactaagaaccaggtttctctcacatgtctggtgaaaggcttctatccctcagacatagctgtagagtgggaaagtaatggtcagcctgagaacaactacaagaccacgccaccggtcttagacagcgatgggtcctttttcctgtattctaaactcaccgtggacaagtcgcgatggcagcaaggcaatgttttcagctgctccgtgatgcacgaagcccttcataaccactacacacagaaatcactgagtttgtctcccggaaag

SEQ ID NO: 22944 - RNA, 645 nt, synthetic construct
  misc_feature 1..645: note = derived and/or modified sequence opt3 from Afasevikumab_LightChain1
  source 1..645: mol_type = other RNA
gagatcgtgctgacccagagccccgccacactctccctttctcctggcgaaagagctactctgtcatgcagggcaagtcaaagcgtccggtcctacttggcctggtatcagcagaagccagggcaggcgccgcgcttactgatttacgacgcttctaaccgagccacgggaatacccgcacgtttctcgggttcaggcagcgggaccgattttacactaactatcagttccctcgagcctgaagacttcgccgtttattactgtcaacagagatctaattggccacccgctacctttggaggcggtacaaaagtggagattaagaggaccgtagcagcccctagcgtgttcatctttccaccctccgatgaacagctgaaatcagggactgctagtgtcgtgtgccttctgaacaatttctatcctcgggaggccaaggttcagtggaaagtggacaacgcgttgcaaagcggaaattctcaggagtccgtcacagaacaggattcaaaggacagcacctacagtctctcttccacgctgactctgagcaaggcagattatgagaaacacaaggtgtacgcctgtgaagtaacccatcagggcctctcgtctccagttacaaaatcctttaaccgcggcgagtgc

SEQ ID NO: 22945 - RNA, 1293 nt, synthetic construct
  misc_feature 1..1293: note = derived and/or modified sequence opt3 from Aflibercept_Fusion_protein1
  source 1..1293: mol_type = other RNA
agcgacaccggcagacccttcgtggagatgtactccgaaatccctgagattatacacatgacagaagggagggagctggtcatcccatgccgggttacttctccgaacattacggtgaccctcaagaaatttccccttgatacactgatccctgacggaaagcgcattatctgggattcacgaaaaggtttcataatcagtaatgccacttataaggaaattggcttgttaacctgtgaggctacagtaaacgggcatctgtacaaaaccaattatctaactcaccgtcagacaaacaccatcattgacgtggtcctcagcccatcccatggaatcgagctgtctgtgggcgaaaagttggttctgaattgcacggcaagaactgagttgaacgtgggtatagattttaattgggaatacccctcgtcaaagcaccaacataaaaagctcgtcaacagggacctgaaaacccagagcgggagtgagatgaagaaattcctgtccacactcactattgatggagtgacccggtctgaccagggcttatatacatgtgccgcgagctccggcctgatgaccaagaaaaattcaacgtttgtacgcgttcacgagaaggataagactcacacatgccctccatgtcccgctcctgaacttcttgggggaccaagtgtgttcctgtttccgcccaaacctaaggacaccctaatgatcagcagaactccagaggtcacatgcgtggtggtcgatgtttctcatgaagaccccgaggtgaaattcaactggtacgtagatggtgtggaagtccacaatgccaagaccaaacctagggaggagcagtataactccacgtaccgggtggtttcagtgctcaccgtcctgcatcaagactggcttaatggcaaggaatacaagtgtaaagtgagcaacaaggcactgccagcccccattgagaaaacaatcagtaaggctaaagggcagccgcgcgaacctcaggtatatactttgcccccatctcgagacgagctcaccaagaatcaggtttccctgacatgcttagtgaagggattttaccctagcgatatcgcagtcgaatgggagtcgaacggccaacccgagaacaattataaaactaccccacccgtgctggactctgatggttccttctttctctactcaaaacttacagtcgacaagagtagatggcagcaggggaacgtgttcagctgttccgttatgcacgaagccctgcacaatcattatacccagaagtctttgagcctatcacctgga

SEQ ID NO: 22946 - RNA, 1332 nt, synthetic construct
  misc_feature 1..1332: note = derived and/or modified sequence opt3 from Afutuzuab_HeavyChain1
  source 1..1332: mol_type = other RNA
caggtgcaactggtccagagcggcgccgaggttaagaaacccgggtcctctgtgaaggtatcatgcaaagctagtggatacgcattcagctattcctggatcaactgggtgagacaggcccctggtcagggcctcgaatgggggaggatttttccaggagacggcgataccgactacaatggtaagttcaaagggcgggtcacaataactgcggataagtctacgtcgaccgcttatgagctttcaagcctgcgcagtgaagacacagccgtgtactattgtgcacgaaacgtttttgatggatactggttggtgtattggggccaaggcactttagtcaccgtgtcctctgccagcacaaaggggccgtccgtattccccctggctccttcaagtaaaagcacctctggaggtactgcagccctaggctgcctcgttaaggactactttccagagcccgtgacagtctcctggaatagtggggctctgaccagcggagtgcacacgttccctgccgtgcttcagagttctggcctgtactccttgagctcggtcgttactgtgccatcttcctcactcggtacccagacatatatctgtaacgtaaatcataaacccagtaacactaaggtggataaaaaggtcgaacctaagagctgcgacaaaacccacacatgtccaccgtgccccgcgcctgagctgctcgggggaccatccgtgtttctgtttccccctaagccaaaagataccttaatttctcgtacgcccgaggttacttgtgtggtcgtggacgtaagccatgaagatccggaggttaagtttaattggtacgtggacggcgtcgaagtgcacaacgcaaaaacaaagcctagagaggagcagtataattcaacctacagggtcgtgagtgttctgactgtgcttcatcaagattggttgaacggcaaagaatataagtgcaaggtatccaataaagccctgcccgctccaatcgagaagacaattagcaaagccaaggggcagcctcgggaaccccaggtctacaccctaccaccctctcgcgacgagctcacgaaaaaccaggtgtcactgacctgtcttgttaagggattctatcctagtgacatcgcagtggaatgggagagcaatggtcaaccagagaacaattacaagacaactccgcccgtcctggattccgacggctctttcttcttgtactcgaaactcaccgtggataagagcagatggcagcaggggaacgtattttcctgctcagtgcacgaagctctgcacaaccattatacacaaaaatcattatctctgagccctgga

SEQ ID NO: 22947 - RNA, 651 nt, synthetic construct
  misc_feature 1..651: note = derived and/or modified sequence opt3 from Afutuzuab_LightChain1
  source 1..651: mol_type = other RNA
gacatcgtgacccagacacccctgagcctccctgtcactccaggcgagccggcctccatttcttgcagatcaagtaagagccttctgcactccaacgggataacgtacttgtattggtacttacaaaaacccggacagtctcctcagctgctaatctatcagtcgaatctcgtttcaggtgtgccagataggttcagcggcagtgggtccggaaccgactttacactgaagatttctcgggtagaagctgaggatgtgggcgtctactattgtgcacaaaaccttgaactgccctacactttcggtgggggaaccaaagtggagatcaagcgcacagttgccgcgcctagcgtgtttattttcccaccctccgacgaacagttgaaatcaggcaccgctagtgtcgtgtgcctcctgaataacttttatcctcgagaggccaaggtacagtggaaggttgataatgcactgcagagcggcaactctcaagagtccgtgactgaacaggactcaaaagatagcacatacagtctctcttccaccttaacgctgagcaaggccgactacgagaaacataaggtctatgcttgtgaagtgactcaccaggggctttcgtctccagtgaccaaatccttcaatcgtggagagtgc

SEQ ID NO: 22948 - RNA, 1347 nt, synthetic construct
  misc_feature 1..1347: note = derived and/or modified sequence opt3 from Afutuzumab_HeavyChain1
  source 1..1347: mol_type = other RNA
caggtgcaactggtccagagcggcgccgaggttaagaaacccgggtcctctgtgaaggtatcatgcaaagctagtggatacgcattcagctattcctggatcaactgggtgagacaggcccctggtcagggcctcgaatggatggggaggatttttccaggagacggcgataccgactacaatggtaagttcaaagggcgggtcacaataactgcggataagtctacgtcgaccgcttatatggagctttcaagcctgcgcagtgaagacacagccgtgtactattgtgcacgaaacgtttttgatggatactggttggtgtattggggccaaggcactttagtcaccgtgtcctctgccagcacaaaggggccgtccgtattccccctggctccttcaagtaaaagcacctctggaggtactgcagccctaggctgcctcgttaaggactactttccagagcccgtgacagtctcctggaatagtggggctctgaccagcggagtgcacacgttccctgccgtgcttcagagttctggcctgtactccttgagctcggtcgttactgtgccatcttcctcactcggtacccagacatatatctgtaacgtaaatcataaacccagtaacactaaggtggataaaaaggtcgaacctaagagctgcgacaaaacccacacatgtccaccgtgccccgcgcctgagctgctcgggggaccatccgtgtttctgtttccccctaagccaaaagataccttaatgatttctcgtacgcccgaggttacttgtgtggtcgtggacgtaagccatgaagatccggaggttaagtttaattggtacgtggacggcgtcgaagtgcacaacgcaaaaacaaagcctagagaggagcagtataattcaacctacagggtcgtgagtgttctgactgtgcttcatcaagattggttgaacggcaaagaatataagtgcaaggtatccaataaagccctgcccgctccaatcgagaagacaattagcaaagccaaggggcagcctcgggaaccccaggtctacaccctaccaccctctcgcgacgagctcacgaaaaaccaggtgtcactgacctgtcttgttaagggattctatcctagtgacatcgcagtggaatgggagagcaatggtcaaccagagaacaattacaagacaactccgcccgtcctggattccgacggctctttcttcttgtactcgaaactcaccgtggataagagcagatggcagcaggggaacgtattttcctgctcagtgatgcacgaagctctgcacaaccattatacacaaaaatcattatctctgagccctggaaag

SEQ ID NO: 22949 - RNA, 657 nt, synthetic construct
  misc_feature 1..657: note = derived and/or modified sequence opt3 from Afutuzumab_LightChain1
  source 1..657: mol_type = other RNA
gacatcgtgatgacccagacacccctgagcctccctgtcactccaggcgagccggcctccatttcttgcagatcaagtaagagccttctgcactccaacgggataacgtacttgtattggtacttacaaaaacccggacagtctcctcagctgctaatctatcagatgtcgaatctcgtttcaggtgtgccagataggttcagcggcagtgggtccggaaccgactttacactgaagatttctcgggtagaagctgaggatgtgggcgtctactattgtgcacaaaaccttgaactgccctacactttcggtgggggaaccaaagtggagatcaagcgcacagttgccgcgcctagcgtgtttattttcccaccctccgacgaacagttgaaatcaggcaccgctagtgtcgtgtgcctcctgaataacttttatcctcgagaggccaaggtacagtggaaggttgataatgcactgcagagcggcaactctcaagagtccgtgactgaacaggactcaaaagatagcacatacagtctctcttccaccttaacgctgagcaaggccgactacgagaaacataaggtctatgcttgtgaagtgactcaccaggggctttcgtctccagtgaccaaatccttcaatcgtggagagtgc

SEQ ID NO: 22950 - RNA, 684 nt, synthetic construct
  misc_feature 1..684: note = derived and/or modified sequence opt3 from Alacizumab_pegol_HeavyChain1
  source 1..684: mol_type = other RNA
gaggtgcagctggtcgaaagcggcgggggactcgttcaacccggtggctcccttagactgtcttgcgccgcttcagggttcacctttagtagctacggaatgtcctgggtgaggcaggcacctggcaagggtttggagtgggtagccacaatcacttctgggggatcgtatacgtactatgtggactcagtcaaaggccggttcaccattagccgcgataacgcgaagaatacattatacctgcagatgaacagtctacgagctgaagacactgccgtgtattactgtgttcgtataggcgaggatgcactcgactattgggggcagggaaccctggtgacagtctcctctgccagcaccaaaggtccatccgtgtttccgcttgctccctcaagtaagagcacttctggcgggacagcagccctgggatgcttggtaaaagattacttccctgaaccagttaccgtgtcctggaactcaggcgctctcacgagcggtgtccacacttttcccgccgtgctgcaaagttctgggctgtactccctcagctcggtggtcaccgttccttcttcctcattaggaacacagacttatatctgtaatgtgaatcataagccaagtaacaccaaggtagacaaaaaggtggagcccaaaagctgcgataagacacacacctgtgcggca

SEQ ID NO: 22951 - RNA, 642 nt, synthetic construct
  misc_feature 1..642: note = derived and/or modified sequence opt3 from Alacizumab_pegol_LightChain1
  source 1..642: mol_type = other RNA
gacatccagatgacccaaagcccctcctctctgtcagccagtgtgggcgatagagtcacaattacttgcagggctagccaggacatagcagggtccctcaactggcttcagcagaagcctggaaaagccatcaagcggctgatttacgcgacgtcttcgttggattcaggtgttccaaaacgcttcagcggcagtcgatccgggtctgactataccttaacaatcagctccctgcaaccggaggattttgctacttactattgtctacagtacggatcatttccccctaccttcggccagggtacaaaggtggaaattaaacgtaccgtagccgcaccaagtgtgttcatctttccccctagcgacgagcagctcaagtctgggactgcctccgtcgtgtgcctgcttaataacttctatccaagagaagctaaggttcaatggaaagtggataatgcactgcagtcaggaaacagccaggagagtgtcacagaacaggactctaaggattccacctacagcttgtcgtctacgctcactctgtccaaagccgactatgagaagcacaaagtgtacgcttgtgaggtaacccatcaaggcctgtcaagtcccgttacaaagagctttaataggggcgaatgc

SEQ ID NO: 22952 - RNA, 1353 nt, synthetic construct
  misc_feature 1..1353: note = derived and/or modified sequence opt3 from Alemtuzumab_HeavyChain
  source 1..1353: mol_type = other RNA
caggtgcaactgcaggagagcggccccgggctcgtcagaccttcccagaccctttctctgacatgcactgtttcaggattcacgtttaccgacttctacatgaactgggtgaggcagccaccgggtcggggcttggaatggatcgggtttattcgcgataaggccaaaggatatacaactgagtacaatcccagtgtaaagggccgagtgaccatgttagtcgacacaagcaaaaaccaattctccctgcgtctatcttcggtgaccgctgcagatactgccgtttattactgtgcgagagaaggtcacacagctgccccttttgactattgggggcagggatcactcgtgaccgtcagcagtgcatccacgaagggcccatctgtgttccccctggcccctagctccaaatcaacttctggcgggaccgctgcacttggatgcctggtaaaggattactttccagagcccgttacagtgagctggaatagtggtgccttgacttccggcgtccataccttccctgctgtgctccagtcaagcgggctgtatagtctgtcttccgtggtcacagttccaagctcgtctctcggaacccagacgtacatatgtaacgtgaatcacaagccgtccaacactaaagtagacaagaaagtggaacccaagtcatgcgataaaacacatacctgtcctccatgccccgcccctgagttactgggcggtccaagtgtctttctttttcccccgaagcctaaggacactttgatgatcagcaggacacccgaggtgacctgtgttgtggtcgatgtgtcccacgaagacccagaggtaaaattcaattggtacgttgatggggtggaagtccataacgcgaagacgaaacctcgggaggagcaatataattctacctaccgcgtggtcagcgtgctgacagttctacaccaggactggctcaacggaaaggaatataaatgcaaggtgtcaaataaagcactgcccgccccaattgagaagactatcagtaaggctaaaggccagcccagagaacctcaggtatacacccttccaccgtccagggatgagctgacaaagaaccaagtcagcttgacttgtctcgtgaaaggcttctatccctctgacattgccgttgaatgggagtcaaatgggcagcctgagaacaattacaagaccacaccacccgtgctggacagtgatggtagctttttcttatattccaaactgaccgtcgacaagtctcggtggcagcaaggaaacgtgttctcgtgcagcgtaatgcacgaagcactccataaccactacactcagaagtccctttcactgagtcctggcaaa

SEQ ID NO: 22953 - RNA, 657 nt, synthetic construct
  misc_feature 1..657: note = derived and/or modified sequence opt3 from Alemtuzumab_HeavyChain_variant_1bey_H
  source 1..657: mol_type = other RNA
caggtgcaactgcaggagagcggccccgggctcgtcagaccttcccagaccctttctctgacatgcactgtttcaggattcacgtttaccgacttctacatgaactgggtgaggcagccaccgggtcggggcttggaatggatcgggtttattcgcgataaggccaaaggatatacaactgagtacaatcccagtgtaaagggccgagtgaccatgttagtcgacacaagcaaaaaccaattctccctgcgtctatcttcggtgaccgctgcagatactgccgtttattactgtgcgagagaaggtcacacagctgccccttttgactattgggggcagggatcactcgtgaccgtcagcagtgcatccacgaagggcccatctgtgttccccctggcccctagctccaaatcaacttctggcgggaccgctgcacttggatgcctggtaaaggattactttccagagcccgttacagtgagctggaatagtggtgccttgacttccggcgtccataccttccctgctgtgctccagtcaagcgggctgtatagtctgtcttccgtggtcacagttccaagctcgtctctcggaacccagacgtacatatgtaacgtgaatcacaagccgtccaacactaaagtagacaagaaagtg

SEQ ID NO: 22954 - RNA, 660 nt, synthetic construct
  misc_feature 1..660: note = derived and/or modified sequence opt3 from Alemtuzumab_HeavyChain_variant_1ce1_H
  source 1..660: mol_type = other RNA
caggtgcaactgcaggagagcggccccgggctcgtcagaccttcccagaccctttctctgacatgcactgtttcaggattcacgtttaccgacttctacatgaactgggtgaggcagccaccgggtcggggcttggaatggatcgggtttattcgcgataaggccaaaggatatacaactgagtacaatcccagtgtaaagggccgagtgaccatgttagtcgacacaagcaaaaaccaattctccctgcgtctatcttcggtgaccgctgcagatactgccgtttattactgtgcgagagaaggtcacacagctgccccttttgactattgggggcagggatcactcgtgaccgtcagcagtgcatccacgaagggcccatctgtgttccccctggcccctagctccaaatcaacttctggcgggaccgctgcacttggatgcctggtaaaggattactttccagagcccgttacagtgagctggaatagtggtgccttgacttccggcgtccataccttccctgctgtgctccagtcaagcgggctgtatagtctgtcttccgtggtcacagttccaagctcgtctctcggaacccagacgtacatatgtaacgtgaatcacaagccgtccaacactaaagtagacaagaaagtggaa

SEQ ID NO: 22955 - RNA, 1311 nt, synthetic construct
  misc_feature 1..1311: note = derived and/or modified sequence opt3 from Alemtuzumab_HeavyChain_variant_8005_H
  source 1..1311: mol_type = other RNA
caggtgcaactgcaggagagcggccccgggctcgtcagaccttcccagaccctttctctgacatgcactgtttcaggattcacgtttaccgacttctacatgaactgggtgaggcagccaccgggtcggggcttggaatggatcgggtttattcgcgataaggccaaaggatatacaactgagtacaatcccagtgtaaagggccgagtgaccatgttagtcgacacaagcaaaaaccaattctccctgcgtctatcttcggtgaccgctgcagatactgccgtttattactgtgcgagagaaggtcacacagctgccccttttgactattgggggcagggatcactcgtgaccgtcagcagtgcatccacgaagggcccatctgtgttccccctggcccctagctccaaatcaacttctggcgggaccgctgcacttggatgcctggtaaaggattactttccagagcccgttacagtgagctggaatagtggtgccttgacttccggcgtccataccttccctgctgtgctccagtcaagcgggctgtatagtctgtcttccgtggtcacagttccaagctcgtctctcggaacccagacgtacatatgtaacgtgaatcacaagccgtccaacactaaagtagacaagaaagtggaagcccccgagttactgggcggtccttcagtctttcttttcccacccaagcctaaagatacattgatgatcagtaggaccccagaggtgacttgcgttgtggtcgacgtgagccatgaagatcccgaggtaaagtttaattggtacgttgacggggtggaagtccacaacgcgaagacaaaaccgcgggaggagcaatataattccacctaccgcgtggtctctgtgctgacggttctacatcaggattggctcaacggaaaggaatataaatgtaaggtgagcaataaagcactgcctgcccccattgagaagaccatctcaaaagctaagggccagccaagagaacctcaggtatacacacttcccccaagtagggacgagctgactaagaaccaagtctccttgacctgcctcgtgaaaggcttctatcccagcgatattgccgttgaatgggagtctaatgggcagcctgagaacaattacaagacaactccaccggtgctggactcagacggaagtttctttttatatagcaaactgaccgtcgataagtcccggtggcagcaaggtaacgtgttctcttgttcggtaatgcacgaagcactccacaaccattacacacagaaaagcctttccctgtcacccggcaag

SEQ ID NO: 22956 - RNA, 633 nt, synthetic construct
  misc_feature 1..633: note = derived and/or modified sequence opt3 from Alemtuzumab_LightChain
  source 1..633: mol_type = other RNA
gacatccagatgacccaaagcccctcctctctgtcagccagtgtgggcgatagagtcacaattacttgcaaggctagccagaacatagacaaatacctcaattggtatcagcagaagcctgggaaagcaccaaaacttctgatctacaacacgaataacttgcaaaccggagttccgtccaggttctctggttcgggctcagggacagattttactttcaccattagcagtttacagcccgaggacatcgccacatattactgtctgcagcacatttcccggcctcgcacctttggacagggcactaaggtggaaatcaagcgaacagtagcggctccatctgtgttcatatttccccctagcgatgagcaactaaagtccggtaccgcctcagtcgtgtgcctcctgaataacttctatccacgtgaagcaaaagttcagtggaaggtggacaatgcccttcagagtgggaacagccaggagtctgtcacggaacaagattccaaagactcaacttacagcctgagttctaccttgacactctccaaggctgattatgagaaacataaggtgtacgcatgtgaggtaactcaccagggactgagctcgcccgttaccaagtcttttaataga

SEQ ID NO: 22957 - RNA, 642 nt, synthetic construct
  misc_feature 1..642: note = derived and/or modified sequence opt3 from Alemtuzumab_LightChain_variant_8005_L
  source 1..642: mol_type = other RNA
gacatccagatgacccaaagcccctcctctctgtcagccagtgtgggcgatagagtcacaattacttgcaaggctagccagaacatagacaaatacctcaattggtatcagcagaagcctgggaaagcaccaaaacttctgatctacaacacgaataacttgcaaaccggagttccgtccaggttctctggttcgggctcagggacagattttactttcaccattagcagtttacagcccgaggacatcgccacatattactgtctgcagcacatttcccggcctcgcacctttggacagggcactaaggtggaaatcaagcgaacagtagcggctccatctgtgttcatatttccccctagcgatgagcaactaaagtccggtaccgcctcagtcgtgtgcctcctgaataacttctatccacgtgaagcaaaagttcagtggaaggtggacaatgcccttcagagtgggaacagccaggagtctgtcacggaacaagattccaaagactcaacttacagcctgagttctaccttgacactctccaaggctgattatgagaaacataaggtgtacgcatgtgaggtaactcaccagggactgagctcgcccgttaccaagtcttttaatagaggcgaatgc

SEQ ID NO: 22958 - RNA, 1341 nt, synthetic construct
  misc_feature 1..1341: note = derived and/or modified sequence opt3 from Alirocumab_HeavyChain1
  source 1..1341: mol_type = other RNA
gaggtgcagctggtcgaaagcggcgggggactcgttcaacccggtggctcccttagactgtcttgcgctgcttcagggttcacctttaacaattacgcaatgaactgggtgaggcaggcccctggaaagggcttggactgggtaagtacaatcagcggttccgggggaactacgaattatgcggattctgtgaaaggccggttcattatatcgcgcgactcaagcaagcacaccttatacctgcagatgaacagtctacgagctgaggatacagccgtctattactgtgcaaaagactccaattggggcaactttgatctctgggggcgtggaactctggtgaccgtttctagcgcctccacaaagggtccatcagtgttcccgcttgctcccagtagcaaatctacctccggcgggactgcagccctgggatgcttggtcaaggactattttcctgaaccagtgacagtatcatggaatagcggcgctctcaccagtggtgttcatacgttccccgccgtgctgcagtcttccgggctgtacagcctctcgtctgtcgtgactgtgccttcctcaagtttaggaacccaaacatatatctgtaacgtcaatcacaagccaagcaacactaaagttgataagaaagtggagcccaagtcctgcgacaaaacccatacatgtcctccatgcccggcgcccgaactgcttggcggcccttctgtatttttgttcccacccaagcctaaggataccctgatgattagcagaacgccagaggtgacttgtgtcgtggttgacgtgtcacacgaggatcccgaagtcaaatttaattggtacgtggacggggtagaggttcataacgcaaagacaaaaccgagggaggaacagtacaatagtacctatcgggtggtctccgtgctaactgtcctccaccaggattggctgaacggaaaggagtacaaatgcaaggtgagcaataaagcccttcctgctcccatcgaaaagacaatttctaaggccaaaggtcagccacgcgagcctcaagtttataccctgcccccatcaagagacgaattgacgaagaaccaggtgagtctcacctgtctggtaaaaggcttctaccccagcgacatcgcagtcgagtgggaatccaacgggcagcctgagaataactataagacaactccaccggtgttagattctgacggatcgtttttcctgtacagcaaactcaccgttgataagtccaggtggcagcaaggcaatgtgttttcatgcagtgtcatgcacgaggcccttcataaccactatacacagaagtctctgagcttgtcccccggt

SEQ ID NO: 22959 - RNA, 660 nt, synthetic construct
  misc_feature 1..660: note = derived and/or modified sequence opt3 from Alirocumab_LightChain1
  source 1..660: mol_type = other RNA
gacatcgtgatgacccagagccccgattccctggccgtctctctcggcgagagagctacaattaactgcaagtcaagtcaaagcgttctttacaggtccaataaccggaatttcctggggtggtatcagcagaaacctggacagccaccgaacttgttaatatactgggcatctactcgcgaatcgggtgtgcccgaccgattttcaggcagcgggagtggaacggatttcaccctgacaatctcctctctacaagccgaggacgtagcggtgtattactgtcagcagtattacactaccccttatacatttggccagggtaccaagctcgaaattaaacgtactgtcgctgccccaagcgtgttcatctttcccccttccgatgagcaactgaagtcagggacagcaagtgttgtgtgccttctgaataacttctacccaagagaagccaaagtccagtggaaggtggacaatgctttgcagagcggaaactctcaggagtccgtaaccgagcaagattcaaaggacagcacgtacagtctctcttccactctgaccctgagcaaagcagattatgaaaagcacaaagtttacgcctgtgaggtgacacatcagggcctctcgtctcccgtcactaagtcctttaataggggcgaatgc

SEQ ID NO: 22960 - RNA, 735 nt, synthetic construct
  misc_feature 1..735: note = derived and/or modified sequence opt3 from ALX-0061_HeavyChain1
  source 1..735: mol_type = other RNA
gaggtgcagctggtcgaaagcggcgggggactcgttcaacccggtggctcccttagactgtcttgcgccgcttcagggagtgtgttcaagatcaacgtaatggcatggtacaggcaggcccctggaaaaggccgggagttggtggcgggtattataagcgggggatccacctcttatgctgactcggtcaagggccgctttacaatctcacgagataatgccaaaaacactttatacctgcagatgaatagcctacgtccagaagacacggcagtgtattactgtgccttcattaccacagagagtgattatgacctcggcagaaggtactgggggcagggaactctggttaccgtgtcctctggtggcgggggaagcggcggtgggtccgaagtccaacttgtggagtcaggaggcggcctggtacagccggggaacagtttgcggctcagctgcgctgcatctggatttacattctcctcatttggtatgagctgggttcgccaggcccccggcaaggggctggagtgggtgagttctatctccggaagcggctcggataccctgtatgctgactctgtcaaaggtagattcactatttccagggataatgccaagacaaccctctacttacagatgaactcactgcggcctgaagacacggcggtgtactattgtactatcgggggcagtcttagccgctcctctcaaggaaccttggtgacagtcagctca

SEQ ID NO: 22961 - RNA, 1347 nt, synthetic construct
  misc_feature 1..1347: note = derived and/or modified sequence opt3 from Amatuximab_HeavyChain1
  source 1..1347: mol_type = other RNA
caggtgcaactgcagcagagcggccccgagctcgaaaagcctggggcctccgtcaaaatctcttgcaaggcttcaggatacagtttcaccggttatacaatgaactgggttaaacagagccacggcaagtcccttgagtggattgggctgataactccatacaatggagcatcttcgtataaccaaaaatttagaggcaaggccacgttgaccgtggacaagtcaagcagtacagcgtacatggatttactgtccctaacttctgaagacagcgctgtatatttctgtgccaggggtgggtacgatggacggggctttgactattggggctccgggaccccggtgacagtctcaagtgcaagcaccaaaggaccctctgtgttccctctcgccccatcctcaaagagcaccagtggtggcacagctgcactggggtgccttgttaaagattactttcccgagcctgtgaccgtctcttggaactccggagccctgacgagcggcgtgcatactttcccagctgtattgcagtcgtctggtctctactccctgtcaagtgttgtgaccgtccccagctcctctctggggacacagacttatatctgtaatgtgaatcacaagcctagcaacaccaaagtggacaagaaggtcgaaccaaaatcatgcgataagacacatacctgtccgccctgccctgccccagagctcttaggaggccccagtgtttttctgttccctccaaaacccaaggacacgcttatgatttcccgcactccggaggtgacatgtgtagtggtcgatgtgagccacgaagaccctgaggttaaatttaattggtacgtggatggcgtcgaagtgcataacgcgaagaccaaaccccgagaggagcagtataattctacttaccgtgtagtttcagtgttgacagtcctgcaccaagactggctaaacgggaaggaatataagtgcaaagtgagtaataaggcactcccagcccctatcgagaaaaccattagcaaggctaaaggacagcccagagaaccacaggtctacacgctgcccccttccagggatgagcttaccaagaaccaggtgtctctgacatgtttggttaagggtttctatccatcggacatcgccgtggaatgggagagcaatggccaaccggagaacaattacaaaactactccccctgtactcgactccgatgggtcatttttcctgtacagtaagttaacagtcgacaaatctcggtggcagcagggaaacgtgtttagctgctccgttatgcacgaagcactgcataaccactatactcaaaagtcactcagcctttctccaggcaaa

SEQ ID NO: 22962 - RNA, 639 nt, synthetic construct
  misc_feature 1..639: note = derived and/or modified sequence opt3 from Amatuximab_LightChain1
  source 1..639: mol_type = other RNA
gacatcgagctgacccagagccccgccattatgtccgcttctcctggcgaaaaggtgacaatgacttgctcagcaagtagctccgtctcttacatgcactggtatcaacagaaatcggggacgtcaccaaagagatggatatacgataccagcaaactcgccagtggagttccgggtaggttctccggctctgggagcggaaactcctattcacttacaatcagtagcgtggaggcggaagacgatgctacttactattgtcagcagtggtctaagcatcccctgacctttggctccggtacaaaagtagagattaagcggaccgtggccgcaccttcagtcttcatctttccacccagcgacgaacaattgaagagtgggactgcctctgtggtttgcttactgaataacttctaccctcgcgaggctaaagtgcagtggaaggtcgataatgcactacagtccggaaacagccaggagtcggtgacagaacaagactctaaagattccacctattcactcagtagcacgctgactctttccaaggccgactacgagaaacacaaggtatacgcttgtgaagttacccatcagggcctgtctagcccagtgacaaagtcatttaatcgaggcgagtgc

SEQ ID NO: 22963 - RNA, 1350 nt, synthetic construct
  misc_feature 1..1350: note = derived and/or modified sequence opt3 from Anetumab_ravtansine_HeavyChain1
  source 1..1350: mol_type = other RNA
caggtggagctggtccaaagcggcgccgaagttaagaaacccggggagtccctcaagatctcttgcaaaggatcaggttacagtttcaccagctattggattggctgggtgagacaggctcctgggaagggacttgaatggatgggcataatcgacccaggtgattccaggacacggtactctccgtcgtttcaggggcaggtaactatttcagcagacaaaagcatcagtacggcctatctgcaatggtcctctttgaaggcgagcgataccgctatgtactattgtgcccgcggacagttatacggcggcacatatatggacgggtggggacagggtactctggtgaccgtctcctcagcaagtacaaagggccccagcgtgttccctctagccccatcttccaaatcaaccagcgggggaactgctgcactcggctgcctggttaaggattactttcccgagcctgtgacagtcagttggaactctggtgcccttacctccggggtgcacacgttcccagctgtactgcagagctcgggattgtactctctctcctcagttgtgactgtccccagtagctccctgggcacccaaacatatatttgtaatgtgaaccataaaccttctaatactaaggtggacaaaaaggtcgaaccaaagagctgcgataaaacccacacatgtccgccctgccctgccccagagctgctcggcgggccctcagtttttctcttccctccaaagcccaaagacaccctgatgatcagtcgaacgccggaggtgacttgtgtagtggtcgatgtgtcccatgaagaccctgaggttaagtttaactggtacgtggatggagtcgaagtgcacaatgcgaaaacaaagccccgtgaggagcagtataacagcacctacagagtagtttctgtgcttactgtcttgcatcaggactggctgaatggtaaagaatataagtgcaaggtgtcaaacaaagcactaccagcccctatagagaagacaatcagtaaagctaagggccagcccagggaaccacaagtctacaccttaccccctagccgggatgagctgacgaaaaatcaggtgtcccttacctgtctggttaaggggttctatccatctgacattgccgtggaatgggagtcgaacggacagccggagaataactacaagacaactccccctgtattggacagcgatggctcctttttcctctactcaaaactgaccgtcgacaagagtcgctggcaacagggtaatgtgttttcttgcagcgttatgcacgaagcattacacaaccattatacacagaaatccctgtcactcagcccagggaag

SEQ ID NO: 22964 - RNA, 651 nt, synthetic construct
  misc_feature 1..651: note = derived and/or modified sequence opt3 from Anetumab_ravtansine_LightChain1
  source 1..651: mol_type = other RNA
gacatcgccctgacccagcccgctagcgtgtccggctctcctgggcaatcaattacaataagttgcactggaacgagctccgatatcggtggctacaactctgtctcgtggtatcagcagcacccagggaaggcaccgaaactcatgatttacggagttaataacagaccctcaggcgtgagcaataggttcagtggttccaagtctgggaacaccgccagccttacaatctccggactgcaggcggaggacgaagctgattattactgttcaagttatgacattgagagcgccactcctgtatttggcggcgggaccaaattgacagtgttaggacaaccaaaggcagccccctctgtcaccctgttccctccatcctcagaggaactacaggctaataaagcaactctcgtgtgcctgatcagcgatttttaccccggtgccgttacagtggcttggaagggcgacagttctcctgtcaaggccggggtggaaaccacgactccatccaaacagagcaacaataagtatgcggcatcgtcttacctttccctgaccccggagcagtggaaatcacatcggagttacagctgtcaagtaacacacgagggatccactgttgaaaagaccgtggcccccacagagtgctct

SEQ ID NO: 22965 - RNA, 1341 nt, synthetic construct
  misc_feature 1..1341: note = derived and/or modified sequence opt3 from Anifrolumab_HeavyChain1
  source 1..1341: mol_type = other RNA
gaggtgcagctggtccaaagcggcgccgaagttaagaaacccggggagtccctcaagatctcttgcaaaggatcaggttacattttcaccaactattggatagcttgggtgagacagatgcctggcaaggggcttgaaagtatgggaatcatttacccaggcgacagcgatatcaggtattccccgtcttttcagggtcaggtaacaatttcggcagacaaatcaatcactacggcctacctgcaatggagcagtttgaaggcgtccgataccgctatgtattactgtgcccggcacgacatagaggggttcgattattggggacgcggcacattagtgactgtctctagcgcatccaccaagggcccctcagtgtttcctctggccccaagtagcaaatctacatccgggggaaccgctgcactaggttgcctcgttaaggactacttccccgaacctgtgactgtctcatggaatagcggcgccctgacaagtggggtgcatacctttccagctgtacttcagtcttccggactgtacagcttgtcgtctgttgtgacggtcccctcctcaagtctcggcactcagacctatatctgtaacgtgaatcacaaacctagcaacacaaaggtggataaacgagtcgagccaaagtcctgcgacaagactcatacctgtccgccctgccctgccccagagttcgaaggtgggccctctgtttttctgttccctccaaaacccaaggatacactgatgattagccgtaccccggaggtgacgtgtgtagtggtcgacgtgtcacacgaagatcctgaggttaaatttaattggtacgtggacggagtcgaggtgcataacgcgaagactaaacccagagaggaacagtataatagtacatacagggtagtttccgtgctcaccgtcttacaccaagattggctgaacggcaaggaatataaatgcaaggtgagcaataaggcacttccagcctctatcgagaaaactatttcaaaggctaaaggccagcctcgggaaccccaggtctacacattgccacccagtcgcgaggagatgaccaagaaccaggtgagcctgacgtgtctagttaaagggttctatccttccgacatcgccgtggaatgggagtctaatggacaaccagaaaacaattacaagaccacaccgcccgtactcgactcggatggtagctttttcctgtactccaaacttactgtcgacaagtcaagatggcagcagggcaacgtgtttagttgctctgttatgcacgaggcactgcataatcactatacccaaaagagcttgtccctctcacctgggaaa

SEQ ID NO: 22966 - RNA, 645 nt, synthetic construct
  misc_feature 1..645: note = derived and/or modified sequence opt3 from Anifrolumab_LightChain1
  source 1..645: mol_type = other RNA
gagatcgtgctgacccagagccccggcacactctccctttctcctggggaaagagccactctgtcatgcagggctagtcaaagcgtctcctcttcgttctttgcatggtaccagcagaagccaggacaggccccgcggttgttaatttatggtgcgtcaagccgcgctacgggcatacccgaccgactgagtgggtccggatctggcaccgatttcacactaactatcacccgtctcgagcctgaagactttgccgtttactattgtcaacagtacgatagctccgcaattacattcggtcaggggaccagactggagatcaaaaggactgtggccgctccatcagtatttatttttccccctagtgacgaacagcttaagagcggaacagcatctgtggtctgcctgttgaacaatttctatccacgggaggccaaagtgcaatggaaggttgataacgctctccagtccggcaattcacaggagagcgtgaccgaacaggacagtaaagattctacgtactccctgagctcgactctgaccctctctaaggccgactatgagaagcacaaagtctacgcgtgtgaagtgacacatcaaggcttatcctcacccgtaactaagagtttcaaccgcggggagtgc

SEQ ID NO: 22967 - RNA, 1344 nt, synthetic construct
  misc_feature 1..1344: note = derived and/or modified sequence opt3 from Anrukinzumab_HeavyChain1
  source 1..1344: mol_type = other RNA
gaggtgcagctggtcgaaagcggcgggggactcgttcaacccggtggctcccttagactgtcttgcgccgcttcagggttcacctttatcagttacgcaatgagctgggtgaggcaggcccctggaaagggcttggagtgggtagcgtccatttcttcgggtgggaacacatattacccagactcagtgaaaggacggttcactataagccgcgataatgctaagaacagtttatatctgcagatgaactccctacgagccgaagacacggcagtctactattgtgcccgtctcgatggctactattttggcttcgcttactgggggcagggaaccctggtgacagtttctagcgcatccactaaaggtccgtcagtgtttccccttgcccctagtagcaagtctacctccggcgggacagctgccctgggatgcttggtcaaagactacttcccagagcccgtgaccgtatcatggaatagcggcgcgctcacaagtggtgttcacacatttcctgcagtgctgcaatcttccgggctgtatagcctctcgtctgtcgtgaccgtgccatcctcaagtttaggaacgcagacttacatctgtaatgtcaaccataagcccagcaataccaaggttgataaaaaggtggaacctaaatcctgcgacaagacacacacttgtccaccgtgccccgcccctgaggctctgggcgccccatctgtattcctttttccccctaaaccaaaggataccttgatgattagcagaacacccgaggtgacctgtgtcgtggttgacgtgtcacatgaagatccggaggtcaagttcaactggtatgtggacggcgtagaagttcacaatgcaaaaacgaagcctagggaggagcagtacaacagtacttatcgggtggtctccgtgctgacagtcctacatcaggattggctcaatgggaaagaatacaagtgcaaagtgagcaacaaggctctgcccgccccaatcgagaaaaccatttctaaggcgaagggacaacctcgcgaaccccaggtttatactcttccaccctcaagagaggaaatgactaaaaatcaggtgagtctgacctgtttggtaaagggtttttaccctagcgacatcgccgtcgagtgggagtccaacggccagccagaaaataactacaaaacgaccccgcccgtgctcgattctgacgggtcgttctttctgtatagcaagttaacagttgacaaatccaggtggcaacagggaaacgtgttctcatgcagtgtcatgcacgaggcactgcacaatcattacactcagaagtctctcagcctttcccctggcaag

SEQ ID NO: 22968 - RNA, 654 nt, synthetic construct
  misc_feature 1..654: note = derived and/or modified sequence opt3 from Anrukinzumab_LightChain1
  source 1..654: mol_type = other RNA
gacatccagatgacccaaagcccctcctctctgtcagccagtgtgggcgatagagtcacaattacttgcaaggctagcgagtccgttgacaactacgggaaatctctcatgcactggtatcagcagaagcctggaaaagcaccaaaacttctgatatacagggcctcgaatttggaatcaggtgtgccgagccggttcagtggctccgggtctggaacggattttaccttaacaatcagctccctgcagcccgaggacttcgcgacttattactgtcaacagtcaaacgaagatccttggacctttggcggtgggacaaaggtagagattaagcgcaccgtggctgccccaagtgtcttcatctttccccctagcgacgaacagctaaagtctggaactgcatccgtggtttgcctcctgaataacttctatccacgagaggccaaagtgcagtggaaggtcgataatgcacttcaatcaggcaacagccaggagagtgtgacagaacaggactctaaagattccacctacagcctgtcgtctacgttgactctctccaaggctgactatgagaaacataaggtatacgcctgtgaagttacccaccagggcctgtcaagtcccgtgacaaagagctttaatcgtggggagtgc

SEQ ID NO: 22969 - RNA, 1338 nt, synthetic construct
  misc_feature 1..1338: note = derived and/or modified sequence opt3 from Apolizumab_HeavyChain1
  source 1..1338: mol_type = other RNA
caggtgcaactgcaggagagcggccccgggctcgtcaagccttccgaaaccctttctctgacatgcactgtttcaggattcagtttgacgaactacggtgtgcactgggtaagacagagcccaggcaaagggttagagtggatcggagtgaagtggtccggcggttctaccgaatataatgccgcttttatttcgaggctgacaatatcaaaagacactagcaagaaccaggtcagtctaaaactcaattccctgaccgcagccgatacagcggtgtactattgtgctcggaacgaccgctacgccatggattattgggggcaaggaacccttgttactgtgtctagcgcatccacaaagggcccgtcagtcttccccctggcccctagtagcaagtctacctccggcgggacggctgcattgggatgcctcgtgaaagactactttccagagcccgtaactgtttcatggaatagcggtgccctgaccagtggcgtgcatacattccctgctgtcctgcagtcttccgggctctatagcttatcgtctgtggtgactgtcccatcctcaagtctgggaacccagacatacatctgtaacgttaatcacaagcccagcaacaccaaagtggataagaaagtagaacctaagtcctgcgacaagacgcatacttgtccaccgtgccccgcccctgagcttttgggcggtccatctgtgtttctgtttccccctaaaccaaaggatacactaatgattagccgaacccccgaggtcacttgtgtggttgtggacgtctcacacgaagatccggaggtgaaattcaattggtacgtagacggggttgaagtgcataacgcgaagacaaaacctcgtgaggagcagtataatagtacctacagagtcgtgtccgtcctcacggtgctgcaccaagattggcttaacggaaaggaatataaatgcaaggttagcaataaggcactgcccgccccaatcgagaaaaccatttctaaggctaaaggccagcctagggaaccccaggtgtacacattgccaccctcacgggacgagctcactaagaaccaggtaagtctgacctgtttagtcaaaggcttctatcctagcgatatcgccgtggaatgggagtccaatgggcaaccagagaacaactacaagacaactccgcccgttctggactctgacggatcgtttttcctctatagcaaacttaccgtggataagtcccgctggcagcagggtaatgtcttttcatgcagtgtgatgcacgaagcactgcataaccactacacacaaaagtctttgagcctatcccctggcaaa

SEQ ID NO: 22970 - RNA, 642 nt, synthetic construct
  misc_feature 1..642: note = derived and/or modified sequence opt3 from Apolizumab_LightChain1
  source 1..642: mol_type = other RNA
gacatccagatgacccaaagcccctcctctctgtcagccagtgtgggcgatagagtcacaattacttgcagggctagcgagaacatatactcctatctcgcatggtaccagcagaagcctgggaaagccccaaaacttctggtttctaatgcgaagacgttggctgaaggagtgccgtcgcggttctcaggtagcggcagtgggaagcagtttaccttaacaatctcctctctgcaacccgaggacttcgccacttattactgtcagcaccattatggaaacagctacccttttggccagggtaccaaactagaaattaagcgcacagtagcagccccatccgtgttcatctttcccccttcagatgagcagctcaagagtgggaccgctagcgtcgtgtgcctgcttaataacttctatccacgagaagcaaaagttcaatggaaggtggacaatgccctgcagtctggaaactcccaggagtcagtcactgagcaggatagcaaagacagtacatactctttgtccagcaccctcacgctgtcgaaggctgattacgaaaaacacaaggtgtatgcctgtgaggtaactcatcaaggcctgtcttcccccgttaccaagtcatttaatcgtggcgaatgc

SEQ ID NO: 22971 - RNA, 378 nt, synthetic construct
  misc_feature 1..378: note = derived and/or modified sequence opt3 from Apomab_HeavyChain
  source 1..378: mol_type = other RNA
gaggtgcagctggtccagagcggcgggggagttgaaagacccggtggctccctcaggctttcttgcgccgcttcagggttcacctttgacgattacgcaatgtgggtgcggcaggcccctggaaagggcctggagtgggtaagtggtatcaattggcaagggggaagcacaggctatgcggactccgtgaaaggccgcgtcactatttctcgagataatgctaagaactcgttgtacttacagatgaactcactgcgtgccgaagacacggcagtgtattactgtgccaaaatactaggggctggaagaggttggtatttcgattactggggcaaggggaccacagttactgtgagcagtgcatccaccaaaggacca

SEQ ID NO: 22972 - RNA, 324 nt, synthetic construct
  misc_feature 1..324: note = derived and/or modified sequence opt3 from Apomab_LightChain
  source 1..324: mol_type = other RNA
agcgagctgacccaggaccccgccgtgtccgtcgctctcggccaaacagttagaatcacttgctctggggattcacttaggagttactatgcaagctggtaccagcagaagcctggacaggccccagtgctggtaatttatggtgcgaacaatcggccgtccggcatacccgaccgcttctctgggtcgtcaagcggaaacacggctagtttgaccatcacaggcgcccaagcagaagatgaggccgactactattgtaattccgctgattctagcggtaaccacgtggtctttgggggaggcactaaattaaccgtgctgggc

SEQ ID NO: 22973 - RNA, 645 nt, synthetic construct
  misc_feature 1..645: note = derived and/or modified sequence opt3 from Aquaporumab_LightChain
  source 1..645: mol_type = other RNA
gagatcgtgctgacccagagccccggcacactctccctttctcctggggaaagagccactctgtcatgcagggctagtcaaacggtccggaccaactacttggcatggttccagcagaagccaggacaggccccgcgcttactgatttttggtgcgagctcccgagctacaggcatacccgaccgtttctctgggtcgggatcaggcactgattttaccctaacaatcagcagactcgagcctgaagacttcgccgtttattactgtcaacagtatggtagttccccatggacctttgggcagggaactaaagtggagattaagaggacagtagcagccccctctgtgttcatctttcctccaagcgatgaacagctgaaatccggcaccgcttcagtcgtgtgccttctgaataacttctacccccgggaggcaaaggttcaatggaaagtggacaatgccttgcagagtggcaacagccaggagtctgtcacggaacaggattccaaggactcaacttatagcctcagttctaccctgacactgtccaaggctgattacgagaaacacaaggtgtatgcctgtgaagtaactcatcaagggctcagctcgcctgttaccaaatcttttaatcgcggagagtgc

SEQ ID NO: 22974 - RNA, 1326 nt, synthetic construct
  misc_feature 1..1326: note = derived and/or modified sequence opt3 from Arcitumomab_99tc_HeavyChain
  source 1..1326: mol_type = other RNA
gaggtgaagctggtcgaaagcggcgggggactcgttcagcccggtggctcccttagactgtcttgcgccacctcagggttcacatttactgactactatatgaactgggtgaggcaacctccaggaaaggctttggagtggttaggcttcatcggtaataaagcaaacgggtacacgaccgaatatagtgccagcgtaaaaggacggtttacaatttcccgcgataagtctcagtcgatactgtacctacagatgaatactctccgagcggaggactcagctacctattactgtacacgtgatagaggcctgaggttctattttgactactggggccaggggaccactcttacagtgagcagtgccaaaaccacgccgccctccgtctaccctctggcaccaggatctgccgctcaaactaacagcatggtgaccttgggttgcctcgttaagggctatttccccgaacctgtgacagtcacttggaactccgggtcactgagtagcggagtgcacacctttccagcagtactgcagtctgatctctacacattatcctcaagcgttaccgtgcccagttctcctcggccatccgagacggtcacttgtaatgtggcccatccggctagctcgacaaaggtggacaaaaagatcgtcccccgcgattgccctccatgtaaatgccccgcccctaatctgcttggcggtccatctgttttcatttttcccccgaagatcaaagacgtgttgatgatttccctgtcacctatcgtaacctgtgtggtcgtggatgttagtgaggacgatcccgacgtgcagataagctggttcgtcaacaatgtggaagtacacactgcgcagacacaaacccatagagaggattataactccacgctaagggttgtgtctgcactcccaatccagcaccaggactggatgagcgggaaggaatttaagtgcaaagtcaataacaaggacctgcctgcccccattgagcggaccatctcaaaaccaaagggaagtgtgcgcgctccccaggtctacgtgcttcctccaccggaggaagagatgactaaaaagcaagttacactgacctgtatggtgacagatttcatgcccgaagacatttatgtagagtggactaataacggcaaaaccgaattgaattacaagaacacagagcctgtcctcgattccgacggcagctattttatgtactctaagctgcgagtggagaaaaagaactgggttgaaagaaattcatacagttgcagcgtggtccatgaggggttacacaaccaccataccactaaatccttctctagg

SEQ ID NO: 22975 - RNA, 639 nt, synthetic construct
  misc_feature 1..639: note = derived and/or modified sequence opt3 from Arcitumomab_99tc_LightChain
  source 1..639: mol_type = other RNA
cagaccgtgctgagccaatcccccgccatcctctctgcttcacctggcgagaaagtcacaatgacttgcagagcaagtagctccgttacgtacattcactggtatcagcagaaaccagggtcttcgccgaagtcatggatatacgccaccagcaaccttgcgagtggagtgcccgctaggttctccggttctggcagcgggacatcctattcactgactatcagtcgggtagaagccgaggacgcagccacctactattgtcagcattggagctctaaacctccaacatttggaggcggtaccaagttggaaattaaacgcgctgatgcagcccccactgtgtccatcttccctccatcaagcgagcaattaacaagtgggggagcttctgtcgtgtgctttctgaataacttctaccccaaggacattaatgttaagtggaaaatcgatggctccgaacgacagaacggcgtgctaaatagctggaccgaccaggattcgaaggactctacgtattccatgtcaagtactctcaccctgacaaaagatgagtacgagcgtcacaacagctacacttgtgaagccacccataagacatccacctctcctatagtcaagagctttaatagaaacgagtgc

SEQ ID NO: 22976 - RNA, 1329 nt, synthetic construct
  misc_feature 1..1329: note = derived and/or modified sequence opt3 from Ascrinvacumab_HeavyChain1
  source 1..1329: mol_type = other RNA
caggtgcaactgcaggagagcggccccgggctcgtcaagccttcccagaccctttctctgacatgcactgtttcaggaggtagtatcagctccggcgaatactattggaactggattagacagcacccagggaaaggattggagtggataggctacatctattactctggttcgacgtattacaatccgtcattaaagagcagggtgaccattagtgtagacacatccaaaaaccaattctctctgaagctaagctccgtgactgccgctgataccgcagtctattactgtgcccgggaatcagtggcggggtttgactactggggacagggcacactcgttaccgtgagtagcgcttctactaaaggcccctccgtcttccctctggccccatgctcacgcagcacaagtgagtctaccgcagcccttgggtgtctggtgaaggattattttcccgaacctgtaacggtttcctggaatagcggagctttgacttcgggtgtgcataccttcccagcagtcctccagtcttccggcctgtactcactgagtagcgtggtgacagtcccctcctctaactttgggactcagacctatacatgcaatgttgaccacaagcctagcaacaccaaagtggataagacggtagagcgaaaatgttgcgtggagtgtccaccgtgccccgcccctccagtcgctggaccctcagtgttcctctttcctccaaagcccaaagacactttaatgatcagtcgtacaccggaagttacctgtgtggtcgtggatgtatcccatgaggaccctgaagttcaattcaattggtacgtggatggcgtcgaggtgcacaacgccaagactaagcccagagaggaacagtttaatagcacattcagggtcgtgtctgttctgaccgtggtacatcaggactggcttaacggtaaagagtataagtgcaaagtctcaaataaggggttgccagcgcctattgagaaaacgatcagtaagaccaaaggacagccccgggaaccacaagtgtacacactgccccctagccgcgaagagatgactaagaaccaggtttccctaacctgtctcgtgaagggcttttatccatctgatatagcagtcgagtgggaatcgaatggccagccggagaacaattacaaaacaactccccctatgctggacagcgatgggtccttctttctttactcaaagctgaccgtggacaaaagtagatggcaacagggaaacgtattctcttgcagcgtgatgcacgaagccttgcacaaccattatacacagaagtccctctcactgagcccaggt

SEQ ID NO: 22977 - RNA, 645 nt, synthetic construct
  misc_feature 1..645: note = derived and/or modified sequence opt3 from Ascrinvacumab_LightChain1
  source 1..645: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtacgtcaagccgcgcgaccggcatacccgaccgattcagtgggtccggatctggcacagattttactctaaccatcagccgtctcgagcctgaagacttcgctgtttattactgtcaacagtatggttcctcaccaattacatttgggcagggaaccagactggagatcaaaaggactgtggccgcacccagtgtattcatttttcctccaagcgatgaacagcttaagtctggcacagcctccgtggtctgcctgttgaacaatttctacccccgggaggctaaagtgcaatggaaggttgacaacgcactccagtcaggcaatagccaggagagtgtgaccgaacaggattctaaagactccacgtatagcctgtcgtctactctgaccctctccaaggccgattacgagaagcacaaagtctacgcttgtgaagtgacacatcaagggttatcaagtcctgtaactaagagctttaaccgcggagagtgc

SEQ ID NO: 22978 - RNA, 1314 nt, synthetic construct
  misc_feature 1..1314: note = derived and/or modified sequence opt3 from Aselizuab_HeavyChain1
  source 1..1314: mol_type = other RNA
gaggtgcagctggtcgaaagcggcgggggactcgttcaacccggtggctcccttagactgtcttgcgccgcttcagggttcacctttagtacatacgcaagctgggtgaggcaggcccctggaaagggcttggagtgggtagcgtccatctctactggtgggtcgacgtattacccagactcagtgaaaggacggttcaccattagccgcgataacgctaagaatacattatatctgcagaacagtctacgagccgaagacactgcagtctactattgtgcccgtgattacgacggctattttgattactggggccaggggaccctcgtgacagtttcctctgctagcaccaaaggaccgtccgtgttccccctggcaccttgctcaagaagtactagcgagtctacagccgctcttggttgtctggtcaaggactactttccagaacccgtgaccgtatcctggaactcaggcgccttgacgagcggggttcacactttccctgcggtgctccaaagttctggactgtattccctgagctcggtcgtgaccgtgccatcttcctcactcggcacaaaaacttatacctgcaatgtcgatcataagcccagtaatacaaaggttgacaaaagggtggagagcaagtacggtcctccatgtccgtcctgccccgcacctgagtttttagggggaccatctgtattcctgtttccccctaaaccaaaggatacccttataagccggacgcccgaagtgacttgtgtcgtggttgacgtgtcacaggaggatccggaagtccagttcaactggtacgtggacggcgtagaggttcacaatgccaaaacaaagcctcgcgaggaacagtttaacagtacctatagagtggtctccgtgttgactgtcctgcatcaagattggctaaatggcaaggagtacaaatgcaaggtgagcaacaaagggctcccctcttcaatcgaaaagacaattagtaaagctaagggacagccaagggagcctcaggtttataccctgcccccaagccaggaagagacgaaaaatcaagtgtcccttacctgtctggtaaagggtttctacccctctgacatcgccgtcgagtgggaatcgaacggccagcctgagaataactacaagacaactccaccggtgttggacagcgatgggtcctttttcctctattcacggctgaccgttgacaaaagtcgctggcaggaaggaaatgtgttctcttgcagcgtccacgaggcattacataaccactacacacaaaagtccctgtcactcagccttggcaaa

SEQ ID NO: 22979 - RNA, 1311 nt, synthetic construct
  misc_feature 1..1311: note = derived and/or modified sequence opt3 from Aselizuab_HeavyChain2
  source 1..1311: mol_type = other RNA
gaggtgcagctggtcgaaagcggcgggggactcgttcaacccggtggctcccttagactgtcttgcgccgcttcagggttcacctttagtacatacgcaagctgggtgaggcaggcccctggaaagggcttggagtgggtagcgtccatctctactggtgggtcgacgtattacccagactcagtgaaaggacggttcaccattagccgcgataacgctaagaatacattatatctgcagaacagtctacgagccgaagacactgcagtctactattgtgcccgtgattacgacggctattttgattactggggccaggggaccctcgtgacagtttcctctgctagcaccaaaggaccgtccgtgttccccctggcaccttgctcaagaagtactagcgagtctacagccgctcttggttgtctggtcaaggactactttccagaacccgtgaccgtatcctggaactcaggcgccttgacgagcggggttcacactttccctgcggtgctccaaagttctggactgtattccctgagctcggtcgtgaccgtgccatcttcctcactcggcacaaaaacttatacctgcaatgtcgatcataagcccagtaatacaaaggttgacaaaagggtggagagcaagtacggtcctccatgtccgtcctgccccgcacctgagtttttagggggaccatctgtattcctgtttccccctaaaccaaaggataccataagccggacgcccgaagtgacttgtgtcgtggttgacgtgtcacaggaggatccggaagtccagttcaactggtacgtggacggcgtagaggttcacaatgccaaaacaaagcctcgcgaggaacagtttaacagtacctatagagtggtctccgtgcttactgtcttgcatcaagattggctgaatggcaaggagtacaaatgcaaggtgagcaacaaagggctaccctcttcaatcgaaaagacaattagtaaagctaagggacagccaagggagcctcaggtttataccctgcccccaagccaggaagagacgaaaaatcaagtgtccctcacctgtcttgtaaagggtttctacccctctgacatcgccgtcgagtgggaatcgaacggccagcctgagaataactacaagacaactccaccggtgctggacagcgatgggtcctttttcttgtattcacggctcaccgttgacaaaagtcgctggcaggaaggaaatgtgttctcttgcagcgtccacgaggcactgcataaccactacacacaaaagtccttatcactgagcctcggcaaa

SEQ ID NO: 22980 - RNA, 648 nt, synthetic construct
  misc_feature 1..648: note = derived and/or modified sequence opt3 from Aselizuab_LightChain1
  source 1..648: mol_type = other RNA
gacatccagacccaaagcccctcctctctgtcagccagtgtgggcgatagagtcacaattacttgcaaggctagccagtccgttgactacgatggggactcttataactggtaccagcagaaacctggaaaggcaccaaaactccttatatatgccgcgtcgaatctggagtcaggtatcccgagcaggttcagtggctccgggtctggaacggattttaccttgacaattagctccttacaacccgaagacttcgctacttactattgtcagcagtcaaacgaggatccttggacctttggccagggtacaaaggtggaaatcaaacggaccgtagccgcaccaagtgtgttcatttttccccctagcgacgagcaactgaagtctgggactgcctccgtcgtgtgcctactcaataacttctacccacgcgaagctaaggttcagtggaaagtggataatgcactgcagtcaggaaacagccaggagagtgtcacagagcaagactctaaggattccacctatagcctttcgtctacgctgactttgtccaaagccgactacgaaaagcacaaagtgtacgcttgtgaggtaacccatcagggcctctcaagtcccgttacaaagagctttaatcgaggcgaatgc

SEQ ID NO: 22981 - RNA, 1344 nt, synthetic construct
  misc_feature 1..1344: note = derived and/or modified sequence opt3 from Atezolizumab_HeavyChain1
  source 1..1344: mol_type = other RNA
gaggtgcagctggtcgaaagcggcgggggactcgttcaacccggtggctcccttagactgtcttgcgccgcttcagggttcacctttagtgacagctggatccactgggtgaggcaggcacctggaaagggcttggagtgggtagcctggatttccccatacggtgggtctacatattacgcggattcggtgaaaggacggttcactatatcagctgacacgagcaagaacaccgcctatttacagatgaatagtctgcgcgcagaagatacagccgtctactattgtgctcgacgtcattggccgggcggctttgactactgggggcagggaactctagtgaccgtttcctctgcaagcacaaaaggtccctccgtgttccctctcgccccatcaagtaagagcacctctggcgggactgctgccctgggatgccttgtcaaagattattttcccgagcctgtgacagtatcctggaactcaggcgcgctgaccagcggtgttcacacgttcccagcagtgttgcaaagttctgggctctactccctgagctcggtcgtgactgtgccctcttcctcactgggaacccagacatacatctgtaatgtcaaccataagcctagtaatactaaggttgacaaaaaggtggaaccaaaaagctgcgataagacccacacatgtccgccctgccctgccccagagctcttaggcggcccctccgtatttctgttccctccaaaacccaaggacacccttatgatttctagaacgccggaggtgacttgtgtcgtggttgatgtgagccatgaagaccctgaggtcaagtttaactggtatgtggatggggtagaagttcacaatgctaaaacaaagcccagggaggagcagtacgcctcaacctatcgggtggtcagtgtgttgactgtcctgcaccaggactggctaaacggaaaagaatacaagtgcaaagtgtccaataaggcactcccagctcctatcgagaaaacaattagcaaggccaagggtcaaccccgcgaaccacaggtttataccctgcccccttctagagaggaaatgacgaaaaaccaggtgtcacttacctgtctggtaaagggcttctacccaagtgatatcgcggtcgagtgggagagcaatgggcagccggaaaacaattataaaacaactccccctgtgttggactccgacggatctttctttctctactcgaagctgaccgttgataaatccaggtggcaacagggcaacgtgtttagctgctcagtcatgcatgaggccttacacaatcattacacacagaagagtctgtctctcagcccaggtaag

SEQ ID NO: 22982 - RNA, 642 nt, synthetic construct
  misc_feature 1..642: note = derived and/or modified sequence opt3 from Atezolizumab_LightChain1
  source 1..642: mol_type = other RNA
gacatccagatgacccaaagcccctcctctctgtcagccagtgtgggcgatagagtcacaattacttgcagggctagccaggacgtttccacggcagtggcctggtaccagcagaagcctgggaaagcgccaaagctccttatatattctgcttcgttcctgtactcaggagtaccgagccggtttagtggttccggctctgggaccgatttcacattgactatcagctccttacaacccgaggactttgccacctattactgtcagcagtatctgtaccaccctgcaacattcggacagggcaccaaagtggaaattaagcgcactgtcgccgctccatcagtgtttatctttccccctagtgatgagcaactaaaaagcggtacagcatctgttgtgtgcctcctgaacaatttctatccacgagaagccaaggtccagtggaaggtggacaacgcccttcagtccggaaattcacaggagagcgtaaccgaacaagatagtaaagactctacgtactccctgagctcgactttgaccctctctaaggctgattacgagaaacataaggtttatgcgtgtgaggtgacacaccaggggctgtcctcacccgtcactaaaagtttcaaccgtggcgaatgc

SEQ ID NO: 22983 - RNA, 1323 nt, synthetic construct
  misc_feature 1..1323: note = derived and/or modified sequence opt3 from Atinumab_HeavyChain1
  source 1..1323: mol_type = other RNA
gaggtgcagctggtcgaaagcggcgggggactcgttcaacccggtggctcccttagactgtcttgcgccgcttcagggttcacctttagtaactactggatgagctgggtgaggcaggcacctggaaagggcttggagtgggtagccacaatcaaacaggacggttcccagaagaattatgtggattctgtcaaagggcggttcactatttcgcgcgacaacgcgaaaaattcattatacctgcgactaaacagcctccgtgctgaagatacggccgtgtattactgtgcaaccgagctgtttgacctttggggaagaggcagtctggttacagtgtcctctgccagcactaagggcccatccgtcttcccgttggctccctgctcaaggagtaccagcgaatctacagcagccctcgggtgtctggtgaaggattattttcctgagccagtaaccgtttcctggaactcaggagctctgactagcggtgtgcacacattccccgccgtcctccaaagttctggcttatactccctgagctcggtggtgaccgtcccttcttcctcacttgggacgaagacttatacctgcaatgttgaccataaaccaagtaatacaaaggtggataaacgggtagagagcaagtacggacccccttgtccatcctgcccggcgcccgaatttttgggcggtccttctgtgttcctgtttccacccaaacctaaggacactctaatgataagccgcaccccagaggtcacatgtgtggttgtggatgtctcacaggaagaccccgaggtgcagttcaactggtacgtagatggggttgaggtgcacaatgcaaagaccaaaccgagagaggaacagtttaacagtacgtatagggtcgtgtccgtcctcactgtgctgcatcaagactggcttaatggaaaggaatacaaatgcaaggttagcaacaaaggcctgccttcttcaatcgagaagacaattagtaaagccaagggccagccccgggaaccacaggtgtataccttgcctcccagccaggaggagatgactaagaatcaagtatccctcacatgtctggtcaaagggttctacccatctgatatcgctgtggaatgggagtcgaacggacagcccgaaaataactataagaccacgcctccagttttagacagcgacggttcctttttcctgtactcacgcctcaccgtggataaaagtcgatggcaggagggcaacgtcttctcttgcagcgtgatgcacgaagcccttcataatcactatacacaaaagtccctgtcattgagcctagggaaa

SEQ ID NO: 22984 - RNA, 642 nt, synthetic construct
  misc_feature 1..642: note = derived and/or modified sequence opt3 from Atinumab_LightChain1
  source 1..642: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccaattacctttggacagggcacaaaactggagatcaagagaaccgtggctgcaccctccgtattcatttttcctccatcagatgaacagcttaaaagtggtactgccagcgtggtctgcctgttgaacaatttctatcccagggaggctaaggtgcaatggaaagttgacaacgccctccagtctggaaattcccaggagtcagtgacagaacaggatagcaaggacagtacctactctctgtccagcacgctgactctctcgaaggcggattatgagaaacacaaggtctacgcatgtgaagtgacccatcaagggttatcttcccctgtaacaaaatcatttaaccggggcgagtgc

SEQ ID NO: 22985 - RNA, 1329 nt, synthetic construct
  misc_feature 1..1329: note = derived and/or modified sequence opt3 from Atlizuab_HeavyChain1
  source 1..1329: mol_type = other RNA
gtgcagctgcaagagagcggccccgggctcgtcagaccttcccagaccctttctctgacatgcactgtttcaggatacagtatcacgagcgaccacgcctggtcctgggtgaggcagccaccgggtcggggcttggaatggattgggtatatatcttactcgggaatcaccacatataacccctcattaaaaagccgcgtaactctgcgagataccagtaaaaatcagttctccctacgtctctctagcgtgacagctgcagacaccgccgtctactattgtgcgagatccctggctaggactacagccgattactggggccaaggttcacttgtgaccgttagtagcgcatctacgaaggggccttccgtgtttccactggccccctcaagcaaaagtacttctggaggcaccgctgcattgggctgcctcgtcaaggactatttccctgagccagtgacagtatcctggaacagcggggccctgacttcgggagttcatacctttcccgctgtgctgcagtcttccggtctctactcattaagtagcgtcgtgacagtgccttcctctagcctgggcacccagacgtacatttgtaatgtcaaccacaaaccatcaaatactaaggttgataagaaagtggaaccgaagagttgcgacaaaacacatacctgtcccccttgcccagcccccgagcttttgggagggccttccgtattcctgtttccacccaagccgaaagatactctaatcagccggacacctgaagtgacctgtgtcgtggttgacgtgtctcacgaggatcccgaggtcaagttcaactggtatgtggacggcgtagaagttcataatgcgaagacgaaaccacgcgaggaacagtacaactcaacctatagagtggtcagtgtgctcacagtcctgcaccaagattggcttaatggtaaggagtacaaatgcaaggtgagcaacaaagcactgcctgcccccattgagaagactatctccaaagctaaggggcagccaagggaaccccaggtttataccttgcctccatctcgggacgagctcacaaagaatcaggtgtcgctgacttgtttagtaaaaggattttacccgagcgatatagccgtcgaatgggagtccaacggccaacccgaaaataactataagaccacacctccagtgctggactcagacggcagtttctttctctactctaaacttaccgttgataagagccgctggcagcaggggaatgtgttctcctgctcagtccacgaggcactgcataaccactacactcaaaagagcttgtctctatcccccgga

SEQ ID NO: 22986 - RNA, 639 nt, synthetic construct
  misc_feature 1..639: note = derived and/or modified sequence opt3 from Atlizuab_LightChain1
  source 1..639: mol_type = other RNA
gacatccagacccaaagcccctcctctctgtcagccagtgtgggcgatagagtcacaattacttgcagggctagccaggacatatcctcttacctcaactggtatcagcagaagcctgggaaagcaccaaaacttctgatctactatacgtcgcggttgcactcaggagttccgagccgcttcagtggttccggctctgggaccgattttacattcactattagctccttacaacccgaggacatcgccacctactattgtcagcagggaaatacactgccttacacctttggccagggtactaaggtggaaattaagcgaacagtagcggctccatcagtgttcatctttccccctagtgatgagcaactaaaaagcgggaccgcctctgtcgtgtgcctcctgaacaatttctatccacgtgaagcaaaggttcagtggaaggtggacaacgcccttcagtccggaaattcacaggagagcgtcacggaacaagatagtaaagactctacttactccctgagctcgaccttgacactctctaaggctgattacgagaaacataaggtgtatgcatgtgaggtaactcaccagggcctgtcctcacccgttaccaaaagttttaacagaggcgaatgc

SEQ ID NO: 22987 - RNA, 792 nt, synthetic construct
  misc_feature 1..792: note = derived and/or modified sequence opt3 from Aurograb_SingleChain
  source 1..792: mol_type = other RNA
atggccaaggtgcagctgctccaaagcgctaccgaggtcaaaaagcccggcgcatccgttaaagtgtcttgcaaggcctacgggtatacattcactgactacggaatcacgtgggtaagacaggcgcctggtcagggccttgaatggatggggtggatttcagcttataacggatacaccaattatgcccagaaatttcaagataggataacaatgactaccgacgcaagtacaagcaccgcctacatggagctgcggtccttgcgcccagatgacactgctgtgttatattgtgcacgagatcgtgaagacgcctctctgctaagagatggccactggggtcaggggacactcgtcaccgtgtcgtcaggaggcggcgggagcggaggtggcgggagtggaggcggtgggtccggaggcggcgggtctgagacgactctgacccagagcccgggaacactttccctgtcacccggtgaaagggctactttgagttgccgggccagccagatcgtttcttcctcatacctcgcgtggtaccaacagaagcctggccaggcaccacgcctgctgatttatggggccagcagtagagctaccggaatccccgacaggttctctggctccggtagcgggacagattttaccctcacgatttcgaagttagagcctgaggacttcgccgtgtactattgtcagcattacggcagttcctcaccatggacttctcggccccgcgatcaaagcgacatcaaacgagcagctgccctggaacaccatcaccatcaccac

SEQ ID NO: 22988 - RNA, 1350 nt, synthetic construct
  misc_feature 1..1350: note = derived and/or modified sequence opt3 from Avelumab_HeavyChain1
  source 1..1350: mol_type = other RNA
gaggtgcagctgctcgaaagcggcgggggacttgtccaacccggtggctccctgagattgtcttgcgccgcttcagggttcacctttagtagctacatcatgatgtgggttaggcaggcacctggaaagggcttagagtgggtgtcctctatttatccatcgggtgggataacattctacgccgacactgtaaaaggacggtttacgatctcacgcgataacagcaagaataccctgtatctacagatgaacagtctccgagcggaagacacagctgtgtactattgtgcccgtattaaactgggcactgtcaccacagtggattactggggccaggggacccttgttactgtgtcctctgcaagcacaaagggaccgtccgtcttccccctggccccttcaagtaaaagcacctctggtggcacggctgcattggggtgcctcgtgaaggactattttccagagcccgtaactgtttcctggaatagcggagccctgaccagcggcgtgcacacattccctgctgtcctgcaaagttctggtctctactccttaagctcggtggtgactgtcccatcttcctcactggggacccagacatacatctgtaacgttaatcataagcccagtaacaccaaagtggataagaaagtagaacctaagagctgcgacaaaacgcacacttgtccaccgtgccccgcccctgagcttttgggaggcccatccgtgtttctgtttccccctaagccaaaggatacactaatgatttctagaacccccgaggtcacttgtgtggttgtggacgtcagccatgaagatccggaggtgaaatttaattggtatgtagacggcgttgaagtgcacaacgcgaagacaaaacctagggaggagcagtacaattcaacctatcgggtcgtgagtgtcctcacggtgctgcatcaggattggcttaacgggaaggaatacaaatgcaaggtttccaataaagcactgcccgccccaatcgagaagaccataagcaaggctaaaggacaacctcgcgaaccccaggtgtatacattgccaccctctagagacgagctcactaagaaccaggtatcactgacctgtttagtcaaaggtttctaccctagtgatatcgccgtggaatgggagagcaatggccagccagagaacaattataagacaactccgcccgttctggactccgacgggtctttcttcctctactcgaaacttaccgtggataagtcaaggtggcaacagggaaacgtcttttcctgctcagtgatgcacgaagcactgcacaaccattacacacagaagagtttgtctctaagccctggcaaa

SEQ ID NO: 22989 - RNA, 648 nt, synthetic construct
  misc_feature 1..648: note = derived and/or modified sequence opt3 from Avelumab_LightChain1
  source 1..648: mol_type = other RNA
cagagcgccctgacccaacccgcttccgtgtctggctcacctgggcagagtatcacaattagctgcactggaacgtcctctgacgtcggtggctacaactatgtttcgtggtaccagcagcacccagggaaggcaccgaaactcatgatatatgatgtgtcaaatagacccagcggagtaagtaacaggttctccggctctaagagcggtaataccgcctcccttacaatctcagggctgcaagcggaggacgaagctgattactattgtagtagctacacttcttcctcaacccgggtgtttggaacaggcaccaaagtcactgtgttgggccagcctaaggccaacccaacagttaccttatttccccctagcagtgaggaactgcaggcaaataaagccacgctagtgtgcctcatttctgacttctatccaggggctgtcactgtggcatggaaggccgatggatcccccgtaaaggctggtgttgagaccacaaaacctagcaagcagtcgaacaataaatacgccgcgtcttcctacctgtcacttactccagaacaatggaagagtcatcgcagctattcctgtcaggtgacccacgagggctctacagtcgagaaaaccgtggcaccgacggaatgcagc

SEQ ID NO: 22990 - RNA, 1344 nt, synthetic construct
  misc_feature 1..1344: note = derived and/or modified sequence opt3 from Bapineuzumab_HeavyChain1
  source 1..1344: mol_type = other RNA
gaggtgcagctgctcgaaagcggcgggggacttgtccaacccggtggctccctgagattgtcttgcgccgcttcagggttcacctttagtaactacggaatgagctgggttaggcaggcacctggcaagggtttagagtgggtggcctccatccggtctgggggaggccgcacatattactcggacaatgtaaaaggccgattcactatttcacgtgataacagcaagaatacgctgtatctacagatgaacagtctcagagcggaagacaccgctgtgtactattgtgtcaggtacgatcactattccgggtctagcgactactggggacagggtacactggtgactgtttcctcagccagtaccaaaggcccaagcgtgtttccgcttgcaccctcttccaagtcaacaagcgggggaaccgccgctctgggctgcttggtcaaagattacttccctgagccagtgactgtaagttggaactctggtgcactcacatccggggttcatacctttcccgccgtgctgcaaagctcgggactgtattctctctcctcagtcgtgacggtgcctagtagctccttaggcactcagacctacatatgtaatgtcaatcacaagccatctaacacaaaggttgacaaaaaggtggaacccaaaagctgcgataagactcatacctgtcctccatgcccggctcccgagctgcttggcgggccttcagtattcttgtttccacccaaacctaaggacacactgatgatcagtcggaccccagaggtgacgtgtgtcgtggttgatgtgtcccacgaagaccccgaggtcaagttcaattggtatgtggatggagtagaagttcataacgccaaaactaagccgcgcgaggagcagtacaatagcacatatagagtggtctctgtgctaaccgtcctccaccaggactggctgaacggtaaagaatacaagtgcaaagtgtcaaataaggcgcttcctgcacccattgagaaaactatcagtaaggccaagggccaaccaagggaacctcaggtttatacactgcccccaagccgggaggaaatgaccaaaaaccaggtgtccttgacgtgtctcgtaaaggggttttacccctctgatattgctgtcgagtgggagtcgaatggacagcctgaaaacaactacaaaaccacaccaccggtgctggacagcgacggctccttctttttatattcaaagctgactgttgataaaagtcgctggcaacagggtaatgtgttctcttgcagcgtcatgcacgaggccctccataaccactacacccagaagtccctttcactgagccccggg

SEQ ID NO: 22991 - RNA, 657 nt, synthetic construct
  misc_feature 1..657: note = derived and/or modified sequence opt3 from Bapineuzumab_LightChain1
  source 1..657: mol_type = other RNA
gacgtggtcatgacccagagccccctgtccctccctgttacaccaggcgagccggcctctatctcatgcaagagtagccaatcccttctggattctgacgggaaaacttacttgaactggttactgcagaagcccggacagtcgcctcagagactaatttatctcgtgtcaaaactggatagcggtgtaccagacaggttcagtggctccgggtctggaacggattttacccttaagataagccgggtggaagctgaggacgtcggcgtgtactattgttggcaaggtacacacttcccccgcacttttgggcagggaaccaaagttgaaatcaagcgaacagtggcagccccttccgtcttcatttttccaccctcagatgagcagctgaagagtggcaccgcgagcgtggtatgcttgctcaataacttctaccctcgtgaagctaaagttcagtggaaggtggacaatgccctgcaatctggcaactcccaggagtcagtcactgagcaggatagcaaagacagtacatattctctgtccagcaccctcacgttatcgaaggcagattacgaaaaacataaggtgtatgcctgtgaggtgactcaccaggggctgtcttccccagtcaccaagtcatttaatagaggagaatgc

SEQ ID NO: 22992 - RNA, 1338 nt, synthetic construct
  misc_feature 1..1338: note = derived and/or modified sequence opt3 from Basiliximab_HeavyChain
  source 1..1338: mol_type = other RNA
cagctgcaacagagcggcaccgtgctcgccagacccggggcttccgtcaagatgtcttgcaaagcatcaggatacagtttcacaaggtattggatgcactggatcaagcagcggcctggtcagggccttgagtggattggggccatatacccaggaaacagcgacacttcctataatcaaaaatttgaaggcaaggcgaaactgacggctgttacctctgcctcgacagcatacatggagttgtcaagcctcactcatgaagatagtgccgtgtattactgttcccgcgactatggttactacttcgatttttgggggcagggaaccacactgaccgtatctagcgcttccactaagggcccgtcagtgttccccctagcacctagtagcaagtctacatccggcgggaccgccgctctcggatgcctggtcaaagactattttccagagcccgtgacggtttcatggaacagcggtgcccttacaagtggcgtgcacaccttccctgcggtcctgcagtcttccgggttgtacagcctctcgtctgtggtaacagttccatcctcaagtctgggaactcagacctatatctgtaatgtgaaccataagcccagcaatacaaaagtcgataagcgagtggaacctccaaaatcctgcgacaagacccacacgtgtccgccctgccctgcaccagagctgctcggcggtccctctgtgtttttattccctccaaagcccaaagatactctgatgattagccgtacaccggaggtcacctgtgttgtggtagacgtgtcacatgaagatcctgaggtcaagtttaactggtacgtggacggggttgaagtgcacaatgccaaaactaagcccagagaggagcaatataacagtacatacagggtcgtgtccgtacttaccgttttgcaccaggattggctgaatggaaaagaatataagtgcaaagtgagcaacaaggctctaccagcccctatcgagaagacgatttctaaagcaaagggccagccccgggaaccacaggtctacaccttacccccttcacgcgacgagctgactaaaaatcaagtgagtcttacttgtctggtcaagggcttctacccaagcgatatcgctgtggaatgggagtccaacgggcagccggagaataactataaaaccacaccccctgttttggactctgacggatcgtttttcctctacagcaagctgactgtggataagtccagatggcagcaaggtaatgtattttcatgcagtgtcatgcatgaagccttacacaaccattatacccagaaatctctgagcctctccccaggcaag

SEQ ID NO: 22993 - RNA, 630 nt, synthetic construct
  misc_feature 1..630: note = derived and/or modified sequence opt3 from Basiliximab_LightChain
  source 1..630: mol_type = other RNA
cagatcgtgagcacccaatcccccgccattatgtctgcttcacctggcgagaaggtcacaatgacttgcagtgcaagctcctctagatcgtacatgcagtggtatcagcagaaaccagggacgtcaccgaagaggtggatatacgacaccagcaaactggccagtggagttcccgcgcggttctccggttctggcagcgggacatcctattcactcactatcagtagcatggaagctgaggatgccgcaacctactattgtcaccaacgatcttcctacacatttggaggcggtaccaaacttgaaattaagcgcactgtggccgctccttcagtattcatctttccacccagcgacgagcagctgaagagtgggacagcatctgtggtctgcttgttaaacaatttctatcctcgtgaagccaaggtgcagtggaaagttgataacgctctgcagtccggaaatagccaagagtcggtgaccgagcaggactctaaggattccacgtactcactaagtagcactctcaccctgtccaaagccgactacgaaaagcataaagtctatgcgtgtgaggtgacacaccagggcctttctagcccagtaactaagtcatttaacagaggcgaa

SEQ ID NO: 22994 - RNA, 1350 nt, synthetic construct
  misc_feature 1..1350: note = derived and/or modified sequence opt3 from Bavituximab_HeavyChain
  source 1..1350: mol_type = other RNA
gaggtgcagctgcaacagagcggccccgaactcgagaagcctggggcctccgtcaaactttcttgcaaggcttcaggatacagtttcaccggttataacatgaattgggttaaacagagccacggcaagtccctggaatggatcgggcatattgacccatactatggagatacatcttacaaccagaaatttagaggcaaggcaactttgacggtggacaagtcgtcaagcaccgcctatatgcaattaaaaagtctgacatccgaggattctgcggtatactattgtgtgaagggtgggtactacggacactggtatttcgacgtctggggcgctggcactaccgtgacagttagctccgcctcaaccaaagggccgagtgtgtttcccctagcacctagctctaagtccacttcaggaggtacagccgctctcggctgcctggtcaaagattacttcccagaacccgtgaccgtaagctggaatagtggggcacttacgtctggagttcatacttttcctgccgtgctgcagtccagcggcttgtattcgctctcttccgtcgtgaccgtgccatcaagtagcctgggtacacagacttacatatgtaacgtcaatcacaagccctccaacaccaaggttgacaaaaaggtggagcctaaatcttgcgataagacacatacctgtccaccgtgccccgctcctgagctgctcgggggaccaagcgtattcttatttccccctaaaccaaaggacacgctgatgatctcaaggactcccgaagtgacatgtgtcgtggttgatgtgagtcacgaggacccggaagtcaaattcaattggtatgtggatggcgtagaggttcacaacgccaagaccaagcctcgggaggaacagtacaattccacttatcgcgtggtcagcgtgcttacagtcttgcatcaagactggctgaacggcaaagagtacaagtgcaaagtgtctaataaggcgctacccgcaccaattgagaaaaccatctcaaaggccaaggggcagcctcgagaaccccaggtttacacgctcccacccagtcgtgatgaactgaccaaaaaccaggtgagccttacatgtctggtaaagggattttatccttccgacattgctgtcgagtgggagtctaatggtcaaccagaaaacaattacaaaactaccccgcccgtgttggactcggatggcagcttctttctctattccaagctgacagttgacaaatcaagatggcagcaggggaacgtgttcagttgctctgtcatgcacgaggccttacataaccactacactcaaaagagcctgtccctctcacctggaaag

SEQ ID NO: 22995 - RNA, 642 nt, synthetic construct
  misc_feature 1..642: note = derived and/or modified sequence opt3 from Bavituximab_LightChain
  source 1..642: mol_type = other RNA
gacatccagatgacccaaagcccctcctctctgtcagccagtctcggcgagagagtgagccttacatgcagggcttcccaggatattgggtcttcgctgaactggttgcagcagggacctgacggtactataaagcggttaatctacgcaacgtcaagcctggatagtggcgtcccaaaacgcttctccgggtctcgaagcggatccgactattcactaaccattagtagcctcgaatctgaggattttgttgactactattgtctgcaatacgtgtcctcaccgcccacattcggcgccggtactaaacttgaactgaagcgtgcggatgctgcccctagcgtatttatcttcccacccagtgacgagcagttgaagtctgggaccgcatccgtggtctgcctcctgaataacttttatcctagagaagccaaagtgcagtggaaggttgataatgctctgcagagcggaaactcgcaagagtctgtgacagagcaggactccaaggattcaacctacagtctcagctccactttaacactgtctaaagcagactatgaaaagcacaaagtctacgcctgtgaggtgacccatcagggccttagctcaccagtaacgaagagtttcaataggggcgaatgc

SEQ ID NO: 22996 - RNA, 624 nt, synthetic construct
  misc_feature 1..624: note = derived and/or modified sequence opt3 from Bavituximab_LightChain_variant_8734_L
  source 1..624: mol_type = other RNA
gacatccagatgacccaaagcccctcctctctgtcagccagtctcggcgagagagtgagccttacatgcagggcttcccaggatattgggtcttcgctgaactggttgcagcagggacctgacggtactataaagcggttaatctacgcaacgtcaagcctggatagtggcgtcccaaaacgcttctccgggtctcgaagcggatccgactattcactaaccattagtagcctcgaatctgaggattttgttgactactattgtctgcaatacgtgtcctcaccgcccacattcggcgccggtactaaacttgaactgaagcgtgcggatgctgcccctagcgtatttatcttcccacccagtgacgagcagttgaagtctgggaccgcatccgtggtctgcctcctgaataacttttatcctagagaagccaaagtgcagtggaaggttgataatgctctgcagagcggaaactcgcaagagtctgtgacagagcaggactccaaggattcaacctacagtctcagcaaagcagactatgaaaagcacaaagtctacgcctgtgaggtgactcatcagggcttatcctctccagtaacaaagagcttcaataggggcgaatgc

SEQ ID NO: 22997 - RNA, 1368 nt, synthetic construct
  misc_feature 1..1368: note = derived and/or modified sequence opt3 from Begelomab_HeavyChain1
  source 1..1368: mol_type = other RNA
caggtgcaactgcagcagagcggcgccgagctcgtcaagcccggggcttccgttaaactttcttgcaaggcatcaggatacaccttcagaagttatgacatcaactgggtgaggcagcggcctgaacaaggtctggagtggattggctggatatttccaggggatggaagcacaaaatacaatgaaaagttcaaaggcaaggccactttgacgaccgacaagtcctcttcgacagcgtatatgcagttatcacgcctgactagcgaggatagtgctgtatacttttgtgcccgatggaccgtggtcggtccggggtatttcgacgtgtggggagcaggcacaaccgttactgtgtcctctgccaaaacaacgccccctagcgtctacccactagctcccggctgcggggataccactggatcctcagtgaccctcggttgtctggtaaagggctattttcctgaaagtgttacagtgacttggaacagcgggtctctttcctcaagcgtccacaccttcccagcactgttgcagagtggactctacacaatgtcttccagcgtgaccgtgccctcgtctacgtggccttcccagactgtcacatgctcagttgcccatccagctagtagcaccactgtggacaaaaagctggagccgtccggccccatctctacaattaatccttgtccaccctgcaaagagtgtcacaagtgccctgccccaaacctggaaggtgggcccagcgtatttatcttcccgcctaatattaaggatgtgctcatgatctcattaacccccaaagtcacgtgtgtggttgtggacgtcagtgaggatgacccagatgtgcaaatatcctggtttgtaaacaatgttgaagtgcataccgcgcagacacagactcaccgtgaggactacaacagcaccatcagagtcgtgtctacactgcctattcagcatcaagattggatgtcaggaaaggagttcaaatgcaaggtcaataacaaagaccttcccagtccaatcgaaaggactattagcaagatcaaaggcttggtgcgggcaccccaggtttatatactgcctccaccggccgagcagctatcccgcaaggacgtgtctctcacctgtctggtagtcggctttaatcccggggatatttcggtggaatggacaagcaacggacacaccgaggaaaattacaaggacactgctcctgttcttgattccgacggttcatatttcatctacagtaaactgaacatgaagacgtctaaatgggagaagacagatagcttttcctgcaatgtgagacacgagggcttgaaaaactattacctcaagaagaccatttcaaggagcccagggaaa

SEQ ID NO: 22998 - RNA, 639 nt, synthetic construct; identical to SEQ ID NO: 22936
  misc_feature 1..639: note = derived and/or modified sequence opt3 from Begelomab_LightChain1
  source 1..639: mol_type = other RNA

SEQ ID NO: 22999 - RNA, 1353 nt, synthetic construct
  misc_feature 1..1353: note = derived and/or modified sequence opt3 from Benralizumab_HeavyChain1
  source 1..1353: mol_type = other RNA
gaggtgcagctggtccaaagcggcgccgaagttaagaaacccggggcttccgtgaaggtatcttgcaaagcatcaggatacaccttcacaagttatgtgatccactgggtcagacagaggcctggtcagggcctcgcctggatggggtacattaacccatataatgacggaactaagtacaacgagcggtttaaaggcaaggtgacgataaccagcgatcgctccacatctactgtttatatggaactttcgtcactgcgaagcgaggacaccgcggtgtacttgtgtggtcgtgaagggatcagatattacggattactgggcgattactggggccaggggaccctagtcacagtgagttccgcttctactaagggaccgagcgtattccccctcgccccttcctcaaaaagtacaagcggtggcaccgcagccctggggtgccttgttaaggactattttccagagcccgtgacggtctcttggaactccggagctctgacttcaggcgtgcataccttccctgcagtgttgcaaagcagtggtctctactctctgtccagcgtcgttacagtgccatcgtcttccctggggactcagacctatatttgtaatgtaaatcacaaaccctcaaacacaaaggtggataaaaaggtcgagcctaagagttgcgacaaaacccatacgtgtccaccgtgccccgcccctgaactcttaggaggcccaagcgtgtttctgtttccccctaagccaaaagatactcttatgatctccaggacacccgaggttacctgtgtggtcgtggacgtatctcacgaagatccggaggttaagttcaattggtacgtggacggcgtcgaggtgcataacgctaaaactaagcctcgggaggaacagtataatagcacataccgcgtcgtgtcagttttgaccgtgctgcaccaggattggctaaacgggaaagaatataagtgcaaggtaagtaataaagccctccccgcgccaattgagaagacgatctccaaagcaaagggacaacctagagaaccccaggtctacaccctgccacccagcagggacgagcttactaaaaaccaggtgtctctgacatgtttggttaagggtttctacccttcagatatagccgtggagtgggaaagtaatggccagccagagaacaattataagaccacaccgcccgtcctcgacagcgacgggtcctttttcctgtactctaaattaactgtggataagtcgcggtggcaacagggaaacgtatttagctgctccgtgatgcacgaagctctgcataaccactatacccagaaatcactcagtctttctcctggcaag

SEQ ID NO: 23000 - RNA, 642 nt, synthetic construct
  misc_feature 1..642: note = derived and/or modified sequence opt3 from Benralizumab_LightChain1
  source 1..642: mol_type = other RNA
gacatccagatgacccaaagcccctcctctctgtcagccagtgtgggcgatagagtcacaattacttgcgggacgagcgaggacataatcaactacctcaattggtatcagcagaagcctggaaaagctccaaaacttctgatttaccacacctccaggttgcagtctggtgttccgtcgcggttctcaggcagcgggagtggaacagattttactttaaccatctcctctctgcaacccgaagacttcgcaacatattactgtcagcagggctataccctaccttacacttttggtcaggggacaaaggtggagattaagcgcaccgtagccgcgccaagcgtgttcatctttcccccttccgatgaacaactcaaatcaggaacggctagtgtcgtgtgcctgcttaacaatttctatccacgagaggccaaggttcagtggaaggtggacaacgcactgcagagcggcaattctcaggaatccgtcactgagcaagattcaaaagacagcacctacagtttgtcttccacactcactctgagcaaggccgattacgagaaacataaggtgtatgcttgtgaagtaacccaccagggcctgtcgtctcccgttacaaaatcctttaaccgtggggagtgc

SEQ ID NO: 23001 - RNA, 1329 nt, synthetic construct
  misc_feature 1..1329: note = derived and/or modified sequence opt3 from Betalutin_HeavyChain1
  source 1..1329: mol_type = other RNA
gaaatccagctgcaacagagcggccccgaactcgtgaagcctggggcctccgtcaaagtttcttgcaaggcttcaggatacagtttcaccgactataacatgtactgggtgaaacagagccacggtaagtcccttgagtggattggctatatagatccatacaatggggacacaacttataaccagaaatttaagggaaaggcaacgctgaccgtagataaatcttcgtcaacagccttcatccatttgaatagcttaacttccgaagactccgcggtgtactattgtgctagatctccgtacggccactacgccatggattattggggtcaagggaccagcgtcacagtgtcctcagcaaagaccactccccctagtgtttacccactggcccccggaagcgctgcacagacaaactctatggtgaccctaggctgcctcgtcaaaggctattttcctgagccagtgacggtaacttggaatagtgggtcactgagcagtggagttcataccttccccgccgtgcttcagtctgacctgtacacattgtccagctcggtcactgtgccttcttccacctggccatcagaaacagtgacctgtaacgtcgctcacccggccagtagcacgaaggttgataaaaagattgtgcccagggactgcggttgtaagccttgcatctgtactgtaccagaggtgtcctctgtctttatttttccccctaaaccaaaggatgtgctcacaatcaccctgactcccaaagttacatgcgtggtcgtggacataagcaaggatgacccggaggtacagttctcatggttcgttgatgacgtggaagtccataccgcgcaaacgcagcctcgggaggaacagtttaatagtaccttccgctccgtgagcgagctgcccatcatgcaccaggactggctcaacggcaaagagtttaagtgtcgagtcaattctgcagccttcccagctcctattgagaaaacaatctcaaagactaaggggcgtcccaaagccccacaagtgtataccattccccctccaaaggaacagatggcaaaagataaggttagtttaacatgcatgatcactgactttttcccggaagatataaccgtggagtggcagtggaacggacaacccgctgaaaattacaaaaacacacagcctattatggacaccgatggcagctatttcgtatactccaagctgaatgtccagaagtctaactgggaggccggtaatacttttacgtgttcggtgcttcacgaggggttgcataaccaccatacagagaaaagcctgtcccactcaccaggaaag

SEQ ID NO: 23002 - RNA, 642 nt, synthetic construct
  misc_feature 1..642: note = derived and/or modified sequence opt3 from Betalutin_LightChain1
  source 1..642: mol_type = other RNA
gacatcgtgatgacccagagccacaagctgctctccacatctgtcggcgatagagtttcaattacttgcaaagccagtcaagacgtgagcacggctgtagattggtaccagcagaagcccgggcagtcccctaaacttctgataaactgggcatctaccaggcatacaggagtgccagaccggttcactggttcgggctcagggaccgattatacattgaccatcagcagtatgcaagccgaggacttagcgctgtactattgtcgccagcactactccactccgtttacattcggatctggcaccaagctagaaattaaacgagctgatgccgcacccacggtcagcatctttcctccatcctcagagcagctcaccagtggtggggccagcgtggtttgcttcctgaataacttttatcccaaggacattaatgtgaagtggaaaatcgatggatctgaacgtcagaacggcgtccttaattcctggactgaccaagattcaaaggacagcacatacagtatgtcttccactctgaccttgacaaaagatgagtatgaaagacataacagctacacctgtgaggctacgcacaagacttcgacatctcctatagtgaaatccttcaataggaacgagtgc

SEQ ID NO: 23003 - RNA, 1344 nt, synthetic construct
  misc_feature 1..1344: note = derived and/or modified sequence opt3 from Bevacituzuab_HeavyChain1
  source 1..1344: mol_type = other RNA
gaggtgcagctggtcgaaagcggcgggggactcgttcaacccggtggctcccttagactgtcttgcgccgcttcagggtacaccttcacaaactatggaaattgggtgaggcaggcacctggcaagggtttggagtgggtagggtggatcaacacttacacgggagaaccaacctatgccgcggactttaaacggcgcttcacatttagtttagatactagcaagtccaccgcttacctgcaaaattctctacgagccgaggacacagcagtgtattactgtgccaaatatccgcactactacggctcgtcacattggtatttcgatgtctggggccaggggaccctcgtgactgttagcagtgcttccacaaagggaccctctgtgtttcctctggcaccaagctccaaatcaaccagtggtggcacggccgctcttgggtgcctggtcaaggactacttccccgaacctgtgactgtaagctggaactctggagccttgacctccggcgttcacacatttccagcggtgctccagtcaagcggtctgtatagtctgtcttccgtcgtgactgtgcccagctcgtctctcgggacccagacatacatttgtaatgtcaaccataagccttccaataccaaagttgataagaaagtggagccaaagtcatgcgacaaaacgcacacttgtccgccctgccctgcaccagagttactgggaggccccagtgtattcctttttcctccaaagcccaaggatacattgataagccgtaccccggaagtgacttgtgtcgtggttgacgtgtcccatgaggatcctgaagtcaaattcaactggtatgtggacggcgtagaggttcacaatgccaagacaaaacccagagaggaacagtacaactctacctatagggtggtcagcgtgctgacggtcctacaccaggattggctcaatgggaaggagtacaaatgcaaggtgtcaaacaaagctctgccagcccctatcgaaaagaccattagtaaggcaaaaggacaaccccgggagccacaggtttacacacttcccccttcccgcgaagagactaagaatcaggtgagcctgacctgtttggtaaaaggtttttatccatctgacatcgctgtcgagtgggaatcaaacggccagccggagaataactacaagacaactccccctgtgctcgatagtgacgggagcttctttctgtattccaaattaaccgttgacaagtctagatggcaacagggaaacgtgttctcgtgcagcgtccatgaagccctgcacaatcattacacacagaagtccctctcacttagtccaggcaaa

SEQ ID NO: 23004 - RNA, 639 nt, synthetic construct
  misc_feature 1..639: note = derived and/or modified sequence opt3 from Bevacituzuab_LightChain1
  source 1..639: mol_type = other RNA
gacatccagacccaaagcccctcctctctgtcagccagtgtgggcgatagagtcacaattacttgcagcgcttcccaggacatatctaactacctcaattggtatcagcagaagcctgggaaagcaccaaaggttcttatctacttcacgtcgtcactgcacagcggagtgccgagtaggttttccggttctggcagcgggaccgatttcacattgactatttcctcattacaacccgaggactttgccacctattactgtcagcagtatagtacagtaccttggaccttcggacagggcactaaagtggaaatcaagcggacagtcgcggctccaagcgtgtttatttttcccccttctgatgagcaactgaaatccggtaccgcctcagttgtgtgcctactcaacaatttctacccacgcgaagcaaaggtccagtggaaggtggacaacgccctgcagagcgggaatagtcaggagtctgtaacggaacaagattccaaagacagcacttattcgctttcttccaccctgacattgtcaaaggctgattacgagaaacataaggtttacgcatgtgaggtgactcaccagggactcagtagccccgtcaccaaatccttcaaccgaggcgaatgc

SEQ ID NO: 23005 - RNA, 639 nt, synthetic construct
  misc_feature 1..639: note = derived and/or modified sequence opt3 from Bevacizumab_154-aspartic_acid_LightChain
  source 1..639: mol_type = other RNA
gacatccagatgacccaaagcccctcctctctgtcagccagtgtgggcgatagagtcacaattacttgcagcgcttcccaggacatatctaactacctcaattggtatcagcagaagcctgggaaagcaccaaaggttcttatctacttcacgtcgtcactgcacagcggagtgccgagtaggttttccggttctggcagcgggaccgatttcacattgactatttcctcattacaacccgaggactttgccacctattactgtcagcagtatagtacagtaccttggaccttcggacagggcactaaagtggaaatcaagcggacagtcgcggctccaagcgtgtttatttttcccccttctgatgagcaactgaaatccggtaccgcctcagttgtgtgcctactcaacaatttctacccacgcgaagcaaaggtccagtggaaggtggacaacgccgatcagagcgggaatagtcaggagtctgtaacggaacaagactccaaagatagcacttattcgctgtcttccacccttacactgtcaaaggctgactacgagaaacataaggtttacgcatgtgaggtgactcaccagggattgagtagccccgtcaccaaatccttcaaccgaggcgaa

SEQ ID NO: 23006 - RNA, 639 nt, synthetic construct; identical to SEQ ID NO: 23005
  misc_feature 1..639: note = derived and/or modified sequence opt3 from Bevacizumab_154-substitution_deriv_LightChain
  source 1..639: mol_type = other RNA

SEQ ID NO: 23007 - RNA, 672 nt, synthetic construct
  misc_feature 1..672: note = derived and/or modified sequence opt3 from Bevacizumab_180-serine_HeavyChain
  source 1..672: mol_type = other RNA
gaggtgcagctggtcgaaagcggcgggggactcgttcaacccggtggctcccttagactgtcttgcgccgcttcagggtacaccttcacaaactatggaatgaattgggtgaggcaggcacctggcaagggtttggagtgggtagggtggatcaacacttacacgggagaaccaacctatgccgcggactttaaacggcgcttcacatttagtttagatactagcaagtccaccgcttacctgcagatgaactctctacgagccgaggacacagcagtgtattactgtgccaaatatccgcactactacggctcgtcacattggtatttcgatgtctggggccaggggaccctcgtgactgttagcagtgcttccacaaagggaccctctgtgtttcctctggcaccaagctccaaatcaaccagtggtggcacggccgctcttgggtgcctggtcaaggactacttccccgaacctgtgactgtaagctggaactctggagccttgacctccggcgttcacacatttccagcggtgtcacaaagcagtggtctctattctctgtccagcgtcgtgactgtgccctcgtcttccctggggacccagacatacatttgtaatgtcaatcataagccttcaaataccaaagttgataagaaagtggagccaaag

SEQ ID NO: 23008 - RNA, 672 nt, synthetic construct; identical to SEQ ID NO: 23007
  misc_feature 1..672: note = derived and/or modified sequence opt3 from Bevacizumab_180-substitution_deriv_HeavyCahin
  source 1..672: mol_type = other RNA

SEQ ID NO: 23009 - RNA, 1359 nt, synthetic construct
  misc_feature 1..1359: note = derived and/or modified sequence opt3 from Bevacizumab_beta_HeavyChain1
  source 1..1359: mol_type = other RNA
gaggtgcagctggtcgaaagcggcgggggactcgttcaacccggtggctcccttagactgtcttgcgccgcttcagggtacaccttcacaaactatggaatgaattgggtgaggcaggcacctggcaagggtttggagtgggtagggtggatcaacacttacacgggagaaccaacctatgccgcggactttaaacggcgcttcacatttagtttagatactagcaagtccaccgcttacctgcagatgaactctctacgagccgaggacacagcagtgtattactgtgccaaatatccgcactactacggctcgtcacattggtatttcgatgtctggggccaggggaccctcgtgactgttagcagtgcttccacaaagggaccctctgtgtttcctctggcaccaagctccaaatcaaccagtggtggcacggccgctcttgggtgcctggtcaaggactacttccccgaacctgtgactgtaagctggaactctggagccttgacctccggcgttcacacatttccagcggtgctccaatcaagcggtctgtatagtctgtcttccgtcgtgactgtgcccagctcgtctctcgggacccagacatacatttgtaatgtcaatcataagccttccaataccaaagttgataagaaagtggagccaaagtcatgcgacaaaacgcacacttgtccgccctgccctgcaccagagttactgggaggccccagtgtattcctttttcctccaaagcccaaggatacattgatgataagccgtaccccggaagtgacttgtgtcgtggttgacgtgtcccatgaggatcctgaagtcaaattcaactggtatgtggacggcgtagaggttcacaatgccaagacaaaacccagagaggaacagtacaactctacctatagggtggtcagcgtgctgacggtcctacaccaggattggctcaatgggaaggagtacaaatgcaaggtgtcaaacaaagctctgccagcccctatcgaaaagaccattagtaaggcaaaaggacaaccccgggagccacaggtttacacacttcccccttcccgcgaagagatgactaagaatcaggtgagcctgacctgtttggtaaaaggtttttatccatctgacatcgctgtcgagtgggaatcaaacggccagccggagaataactacaagacaactccccctgtgctcgatagtgacgggagcttctttctgtattccaaattaaccgttgacaagtctagatggcaacagggaaacgtgttctcgtgcagcgtcatgcatgaagccctgcacaatcattacacacagaagtccctctcacttagtccaggcaaa

SEQ ID NO: 23010 - RNA, 642 nt, synthetic construct
  misc_feature 1..642: note = derived and/or modified sequence opt3 from Bevacizumab_beta_LightChain1
  source 1..642: mol_type = other RNA
gacatccagatgacccaaagcccctcctctctgtcagccagtgtgggcgatagagtcacaattacttgcagcgcttcccaggacatatctaactacctcaattggtatcagcagaagcctgggaaagcaccaaaggttcttatctacttcacgtcgtcactgcacagcggagtgccgagtaggttttccggttctggcagcgggaccgatttcacattgactatttcctcattacaacccgaggactttgccacctattactgtcagcagtatagtacagtaccttggaccttcggacagggcactaaagtggaaatcaagcggacagtcgcggctccaagcgtgtttatttttcccccttctgatgagcaactgaaatccggtaccgcctcagttgtgtgcctactcaacaatttctacccacgcgaagcaaaggtccagtggaaggtggacaacgccctgcagagcgggaatagtcaggagtctgtaacggaacaagattccaaagacagcacttattcgctttcttccaccctgacattgtcaaaggctgattacgagaaacataaggtttacgcatgtgaggtgactcaccagggactcagtagccccgtcaccaaatccttcaaccgaggcgaatgc

SEQ ID NO: 23011 - RNA, 687 nt, synthetic construct
  misc_feature 1..687: note = derived and/or modified sequence opt3 from Bevacizumab_FcDomain
  source 1..687: mol_type = other RNA
agctgcgacaagacccacacatgtcccccttgcccagccccggagctgctcggcgggccctccgtgttcctttttcctccaaaacccaaggatactctgatgatctctagaacgcctgaagtcacctgtgttgtggtagacgtgtcacatgaggatccagaagtcaaattcaactggtacgtggacggagttgaggtgcacaatgctaagacaaaacccagggaagaacagtataacagtacttaccgggtcgtgagcgtattgaccgttttacatcaggattggctgaatggtaaggagtataagtgcaaagtgtccaacaaggcactacctgccccaattgagaaaacaatatctaaggcgaaaggccagccgcgcgagccccaggtctacaccctccctccatcgcgagacgaactgactaagaatcaggtgtcacttacatgtctggtgaaggggttttatcccagcgatatcgctgtcgagtgggagagtaacggacaacctgaaaataactacaaaaccacgccacccgttttggactccgatggctctttctttctctatagcaagctgactgtggacaaatcccgttggcagcagggtaatgtattctcatgcagtgtgatgcacgaggccctgcataaccactacacccaaaagagcctctctttatccccggggaaa

SEQ ID NO: 23012 - RNA, 672 nt, synthetic construct
  misc_feature 1..672: note = derived and/or modified sequence opt3 from Bevacizumab_HeavyChain
  source 1..672: mol_type = other RNA
gaggtgcagctggtcgaaagcggcgggggactcgttcaacccggtggctcccttagactgtcttgcgccgcttcagggtacaccttcacaaactatggaatgaattgggtgaggcaggcacctggcaagggtttggagtgggtagggtggatcaacacttacacgggagaaccaacctatgccgcggactttaaacggcgcttcacatttagtttagatactagcaagtccaccgcttacctgcagatgaactctctacgagccgaggacacagcagtgtattactgtgccaaatatccgcactactacggctcgtcacattggtatttcgatgtctggggccaggggaccctcgtgactgttagcagtgcttccacaaagggaccctctgtgtttcctctggcaccaagctccaaatcaaccagtggtggcacggccgctcttgggtgcctggtcaaggactacttccccgaacctgtgactgtaagctggaactctggagccttgacctccggcgttcacacatttccagcggtgctccaatcaagcggtctgtatagtctgtcttccgtcgtgactgtgcccagctcgtctctcgggacccagacatacatttgtaatgtcaatcataagccttccaataccaaagttgataagaaagtggagccaaag

SEQ ID NO: 23013 - RNA, 1428 nt, synthetic construct
  misc_feature 1..1428: note = derived and/or modified sequence opt3 from Bevacizumab_HeavyChain_variant1
  source 1..1428: mol_type = other RNA
gccagcgctaccatgggctggtcctgcatcattctgttcctcgtggcaacagccactggggtccactctgaggttcagcttgtggaatcaggaggtggcctggtacaacccgggggaagtttgagattaagctgtgcggcttccggctacacgtttaccaactatggtatgaattgggtgaggcaggcccctgggaagggactggagtgggtcggctggataaacacatacactggcgaaccaacctatgcagccgacttcaaacggcgctttacattctctctagatacctcgaagtcaactgcttacctccagatgaatagcctgcgagcagaggacacagccgtgtattactgcgctaaatatccgcattactacgggagttcccactggtattttgatgtttggggacagggtacccttgtgacggtctctagcgcctccactaagggcccctcagtgttccctctggcgccaagtagcaaatctacctccgggggaacagcagccttgggctgtctcgtaaaggactactttcccgaacctgttactgtgtcatggaacagcggtgctctgaccagtggggtccatacattcccagccgtgctgcaatcttccggactctatagcttatcgtctgtggtcaccgttccctcctcaagtctgggcacgcagacttacatctgcaatgtgaaccacaagcctagcaatacaaaagtagataagaaagtggagccaaagtcctgtgacaaaacccatacttgcccgccctgtcctgcaccagagcttttgggcgggccctctgtctttctgttccctccaaagcccaaggatacactaatgattagccgtaccccggaagtgacgtgcgttgtggtcgacgtgtcacacgaggatcctgaagtaaaatttaactggtatgttgacggagtggaggtccacaatgctaagaccaaacccagagaggaacagtacaacagtacatatagggtggtctccgtgctcactgttctgcatcaggattggcttaatggtaaggagtacaaatgtaaggtgagcaacaaagccctgccagcgcctatcgaaaagaccatttctaaggccaaaggccaaccccgggagccacaggtatacacattgcccccttcacgcgaagagatgactaagaatcaggtcagtcttacctgcctggtgaaagggttctatccaagcgacatcgcagttgagtgggaatccaacggacagccggagaataactacaagacaactccccctgtgttagattctgacggctcgtttttcctgtatagcaaactcaccgtcgacaagtccagatggcaacagggtaacgtgttctcatgtagtgtaatgcacgaagctctccataatcactacacgcagaagtctctgagcttgtccccagggaaa

SEQ ID NO: 23014 - RNA, 369 nt, synthetic construct
  misc_feature 1..369: note = derived and/or modified sequence opt3 from Bevacizumab_HeavyChain_V-Region
  source 1..369: mol_type = other RNA
gaggtgcagctggtcgaaagcggcgggggactcgttcaacccggtggctcccttagactgtcttgcgccgcttcagggtacaccttcacaaattatggaatgaattgggtgaggcaggcacctggcaagggtttggagtgggtagggtggatcaacacttacacgggagaaccaacctatgccgcggactttaaacggcgcttcacatttagtttagatactagcaagtccaccgcttacctgcagatgaactctctacgagccgaggacacagcagtgtattactgtgccaaatatccgcactactacggctcgtcacattggtatttcgatgtctggggccaggggaccctcgtgactgttagcagt

SEQ ID NO: 23015 - RNA, 717 nt, synthetic construct
  misc_feature 1..717: note = derived and/or modified sequence opt3 from Bevacizumab_LightChain1
  source 1..717: mol_type = other RNA
gccagcaagctggctaccatgggctggtcctgcatcattctcttccttgtggcaacagccactggggtccactctgacatacagatgacgcaatcacccagtagcctgtccgcgtctgttggagatagagtgaccatcacatgtagggcttcgcaggacatttcaagctacttgaactggtatcagcagaaacctggtaaggccccaaaattactgatctactataccagtcggctacattccggcgtaccgtctcgctttagcgggtccggatcaggcactgatttcacatttaccattagtagcctccaacccgaggacatcgcaacttactattgccagcagggtaatacactgccttacaccttcgggcagggaacgaaggtggaaataaaacgaactgtcgccgctccatctgtgtttatctttcccccttccgatgagcaacttaagtcaggcaccgcaagcgttgtgtgtctgttgaacaatttctatccacgtgaagccaaggtccagtggaaagtggacaacgctctccagagtggcaattctcaggagtccgtaacagaacaagatagcaaggactcgacttactctctgtcctcaaccctgacactcagtaaagccgattacgagaagcacaaagtttatgcgtgcgaggtgacccatcaggggttaagctcccccgtcacgaagtctttcaacagaggagaatgt

SEQ ID NO: 23016 - RNA, 711 nt, synthetic construct
  misc_feature 1..711: note = derived and/or modified sequence opt3 from Bevacizumab_LightChain2
  source 1..711: mol_type = other RNA
gccagcgctaccatgggctggtcctgcatcattctgttcctcgtggcaacagccactggggtccactctgacatacagatgacgcaatcacccagtagcctttccgcgtctgttggagatagagtgaccatcacatgttcggcttcacaggacattagcaactacctgaattggtatcagcagaagcctggtaaagccccaaaggtattgatctactttaccagttccttacattctggcgtgccgagcaggttctccgggtcaggaagtggcactgattttacactgaccattagctctctacaacccgaggacttcgcaacttattactgccagcagtattccacagtcccttggacctttggtcaggggacgaaagtggaaatcaagcggactgttgccgctccatcagtgttcatatttccccctagcgatgagcaactcaaaagtggaaccgcatctgtcgtgtgtctgcttaacaatttctacccacgcgaagccaaggtacagtggaaggttgacaacgctctgcagtccggcaatagccaggagtcggtgacagaacaagattctaaagactccacttattcattgagtagcaccctcacactgtccaaggccgattacgagaaacacaaggtctacgcgtgcgaggtgacccatcagggcctgtctagccccgtgacgaaatcatttaaccgaggggaatgt

SEQ ID NO: 23017 - RNA, 642 nt, synthetic construct; identical to SEQ ID NO: 23010
  misc_feature 1..642: note = derived and/or modified sequence opt3 from Bevacizumab_LightChain
  source 1..642: mol_type = other RNA

SEQ ID NO: 23018 - RNA, 324 nt, synthetic construct
  misc_feature 1..324: note = derived and/or modified sequence opt3 from Bevacizumab_LightChain_VJ-Region
  source 1..324: mol_type = other RNA
gacatccagatgacccaaagcccctcctctctgtcagccagtgtgggcgatagagtcacaattacttgcagcgcttcccaggacatatctaactacctcaattggtatcagcagaagcctgggaaagcaccaaaggttcttatctacttcacgtcgtcactgcacagcggagtgccgagtaggttttccggttctggcagcgggaccgatttcacattgactatttcctcattacaacccgaggactttgccacctattactgtcagcagtatagtacagtaccttggaccttcggacagggcactaaagtggaaatcaagcgg

SEQ ID NO: 23019 - RNA, 321 nt, synthetic construct
  misc_feature 1..321: note = derived and/or modified sequence opt3 from Bevacizumab_LightChain_V-Region
  source 1..321: mol_type = other RNA
gacatccagatgacccaaagcccctcctctctgtcagccagtgtgggcgatagagtcacaattacttgcagcgcttcccaggacatatctaactacctcaattggtatcagcagaagcctgggaaagcaccaaaggttcttatctacttcacgtcgtcactgcacagcggagtgccgagtaggttttccggttctggcagcgggaccgatttcacattgactatttcctcattacaacccgaggactttgccacctattactgtcagcagtatagtacagtaccttggaccttcggacagggcactaaagtggaaatcaag

SEQ ID NO: 23020 - RNA, 369 nt, synthetic construct; identical to SEQ ID NO: 23014
  misc_feature 1..369: note = derived and/or modified sequence opt3 from Bevacizumab-rhuMAb-VEGF_HeavyChain_gamma1-Chain_VDJ-Region
  source 1..369: mol_type = other RNA

SEQ ID NO: 23021 - RNA, 321 nt, synthetic construct; identical to SEQ ID NO: 23019
  misc_feature 1..321: note = derived and/or modified sequence opt3 from Bevacizumab-rhuMAb-VEGF_LightChain_VJ-Region
  source 1..321: mol_type = other RNA

SEQ ID NO: 23022 - RNA, 1341 nt, synthetic construct
  misc_feature 1..1341: note = derived and/or modified sequence opt3 from Bevacizumab_gamma1-Chain
  source 1..1341: mol_type = other RNA
gaggtgcagctggtcgaaagcggcgggggactcgttcaacccggtggctcccttagactgtcttgcgccgcttcagggtacaccttcacaaactatggaatgaattgggtgaggcaggcacctggcaagggtttggagtgggtagggtggatcaacacttacacgggagaaccaacctatgccgcggactttaaacggcgcttcacatttagtttagatactagcaagtccaccgcttacctgcagatgaactctctacgagccgaggacacagcagtgtattactgtgccaaatatccgcactactacggctcgtcacattggtatttcgatgtctggggccaggggaccctcgtgactgttagcagtgcttccacaaagggaccctctgtgtttcctctggcaccaagctccaaatcaaccagtggtggcacggccgctcttgggtgcctggtcaaggactacttccccgaacctgtgactgtaagctggaactctggagccttgacctccggcgttcacacatttccagcggtgctccaatcaagcggtagtctgtcttccgtcgtgactgtgcccagctcgtctctggggacccagacatatatttgtaatgtcaatcataagccttccaataccaaagttgataagaaagtggagccaaagtcatgcgacaaaacgcacacttgtccgccctgccctgcaccagagctcttaggaggccccagtgtattcctgtttcctccaaagcccaaggatacacttatgataagccgtaccccggaagtgacttgtgtcgtggttgacgtgtcccatgaggatcctgaagtcaaattcaactggtacgtggacggcgtagaggttcacaatgccaagacaaaacccagagaggaacagtataactcttacgtggtcagcgtgttgaccgtcctgcaccaggattggctaaatgggaaggagtataaatgcaaggtgtcaaacaaagctctcccagcccctatcgaaaagacgattagtaaggcaaaaggacaacccagggagccacaggtttacaccctgcccccttcccgggacgaacttacaaagaatcaggtgagcctgacttgtttggtaaaaggtttttacccatctgatatcgctgtcgagtgggagtcaaacggccagccggaaaataactataagaccacaccccctgtgctcgacagtgacgggagcttctttaaaaagctgactgttgataagtcccgctggcaacagggaaacgtgttctcttgctcggtcatgcatgaggccttacacaatcattacacccagaaaagcctgtccctctcaccaggcaag

SEQ ID NO: 23023 - RNA, 1359 nt, synthetic construct
  misc_feature 1..1359: note = derived and/or modified sequence opt3 from Bevacizumab_gamma1-Chain_CH3-Region_mutein
  source 1..1359: mol_type = other RNA
gaggtgcagctggtcgaaagcggcgggggactcgttcaacccggtggctcccttagactgtcttgcgccgcttcagggtacaccttcacaaactatggaatgaattgggtgaggcaggcacctggcaagggtttggagtgggtagggtggatcaacacttacacgggagaaccaacctatgccgcggactttaaacggcgcttcacatttagtttagatactagcaagtccaccgcttacctgcagatgaactctctacgagccgaggacacagcagtgtattactgtgccaaatatccgcactactacggctcgtcacattggtatttcgatgtctggggccaggggaccctcgtgactgttagcagtgcttccacaaagggaccctctgtgtttcctctggcaccaagctccaaatcaaccagtggtggcacggccgctcttgggtgcctggtcaaggactacttccccgaacctgtgactgtaagctggaactctggagccttgacctccggcgttcacacatttccagcggtgctccaatcaagcggtctgtatagtctgtcttccgtcgtgactgtgcccagctcgtctctcgggacccagacatacatttgtaatgtcaatcataagccttccaataccaaagttgataagaaagtggagccaaagtcatgcgacaaaacgcacacttgtccgccctgccctgcaccagagttactgggaggccccagtgtattcctttttcctccaaagcccaaggatacattgatgataagccgtaccccggaagtgacttgtgtcgtggttgacgtgtcccatgaggatcctgaagtcaaattcaactggtatgtggacggcgtagaggttcacaatgccaagacaaaacccagagaggaacagtacaactctacctatagggtggtcagcgtgctgacggtcctacaccaggattggctcaatgggaaggagtacaaatgcaaggtgtcaaacaaagctctgccagcccctatcgaaaagaccattagtaaggcaaaaggacaaccccgggagccacaggtttgtacacttcccccttcccgcgacgaactgactaagaatcaggtgagcttgtcttgcgctgtaaaaggtttttacccatcagatatcgccgtcgagtgggagagtaacggccagccggaaaataactataagaccacaccccctgtgctcgacagcgacgggtccttctttctggtttctaaattaactgtggataagtcgagatggcaacagggaaacgtcttcagctgttccgtgatgcatgaggcgctgcacaatcattacacccagaagtcactcagtctttctccaggcaaa

SEQ ID NO: 23024 - RNA, 1347 nt, synthetic construct; identical to SEQ ID NO: 22937
  misc_feature 1..1347: note = derived and/or modified sequence opt3 from Bezlotoxumab_HeavyChain1
  source 1..1347: mol_type = other RNA

SEQ ID NO: 23025 - RNA, 645 nt, synthetic construct; identical to SEQ ID NO: 22938
  misc_feature 1..645: note = derived and/or modified sequence opt3 from Bezlotoxumab_LightChain1
  source 1..645: mol_type = other RNA

SEQ ID NO: 23026 - RNA, 1335 nt, synthetic construct
  misc_feature 1..1335: note = derived and/or modified sequence opt3 from Bimagrumab_HeavyChain1
  source 1..1335: mol_type = other RNA
caggtgcaactggtccagagcggcgccgaggttaagaaacccggggcttccgtgaaggtatcttgcaaagcatcaggatacaccttcacaagtagctatatcaactgggtgagacaggcccctggtcagggcctcgaatggatggggactattaatccagtctccggatctacgtcgtacgcgcaaaagtttcagggcagggtgaccatgacacgggacacttcaataagcaccgcttatatggagcttagtcgcctgcgatccgatgacacagccgtttactattgtgcacgtggtgggtggttcgattactggggacagggcaccttggtgactgtctctagcgcctccacaaaaggcccgtcagtgtttcccttagctcctagtagcaagtctacctccgggggaacggcagccctgggttgcctagtaaaggactatttcccagaacccgttactgtgtcatggaacagcggcgctctcaccagtggggtccacacatttcctgccgtgctgcagtcttccggactttacagcctgtcgtctgtggtcactgttccatcctcaagtttgggcacccaaacatacatctgtaatgtgaaccataaacccagcaataccaaggtagataaaagagtggagcctaagtcctgcgacaaaacgcacacttgtccaccgtgccccgcgcctgaagcagccggtgggccatctgtcttcctctttccccctaagccaaaggatacactgatgattagcaggacccccgaggtgacttgtgttgtggtcgacgtgtcacatgaggatccggaagtaaaattcaactggtatgttgacggagtggaggtccacaatgctaagacaaaacctcgggaggaacagtacaacagtacctatcgcgtggtctccgtgctgacggttctccatcaggattggttaaatggcaaggagtacaaatgcaaggtgagcaacaaagccctgcccgcaccaatcgaaaagaccatttctaaggctaaaggccagcctagagagccccaagtatatacacttccaccctcaagggaagagatgactaagaatcaggtcagtttgacctgtctggtgaaagggttttaccctagcgacatcgccgttgaatgggagtccaacggacagccagagaataactataagacaactccgcccgtgctagattctgacggttcgttctttctctacagcaaactgaccgtcgacaagtcccggtggcaacagggcaatgtgttctcatgcagtgtaatgcacgaagcgcttcacaaccattacacacagaagtctctgagcttgtcccctgggaaa

SEQ ID NO: 23027 - RNA, 1332 nt, synthetic construct
  misc_feature 1..1332: note = derived and/or modified sequence opt3 from Bimagrumab_HeavyChain
  source 1..1332: mol_type = other RNA
caggtgcaactggtccagagcggcgccgaggttaagaaacccggggcttccgtgaaggtatcttgcaaagcatcaggatacaccttcacaagtagctatatcaactgggtgagacaggcccctggtcagggcctcgaatggatggggactattaatccagtctccggatctacgtcgtacgcgcaaaagtttcagggcagggtgaccatgacacgggacacttcaataagcaccgcttatatggagcttagtcgcctgcgatccgatgacacagccgtttactattgtgcacgtggtgggtggttcgattactggggacagggcaccttggtgactgtctctagcgcctccacaaaaggcccgtcagtgtttcccttagctcctagtagcaagtctacctccgggggaacggcagccctgggttgcctagtaaaggactatttcccagaacccgttactgtgtcatggaacagcggcgctctcaccagtggggtccacacatttcctgccgtgctgcagtcttccggactttacagcctgtcgtctgtggtcactgttccatcctcaagtttgggcacccaaacatacatctgtaatgtgaaccataaacccagcaataccaaggtagataaaagagtggagcctaagtcctgcgacaaaacgcacacttgtccaccgtgccccgcgcctgaagcagccggtgggccatctgtcttcctctttccccctaagccaaaggatacactgatgattagcaggacccccgaggtgacttgtgttgtggtcgacgtgtcacatgaggatccggaagtaaaattcaactggtatgttgacggagtggaggtccacaatgctaagacaaaacctcgggaggaacagtacaacagtacctatcgcgtggtctccgtgctgacggttctccatcaggattggttaaatggcaaggagtacaaatgcaaggtgagcaacaaagccctgcccgcaccaatcgaaaagaccatttctaaggctaaaggccagcctagagagccccaagtatatacacttccaccctcaagggaagagatgactaagaatcaggtcagtttgacctgtctggtgaaagggttttaccctagcgacatcgccgttgaatgggagtccaacggacagccagagaataactataagacaactccgcccgtgctagattctgacggttcgttctttctctacagcaaactgaccgtcgacaagtcccggtggcaacagggcaatgtgttctcatgcagtgtaatgcacgaagcgcttcacaaccattacacacagaagtctctgagcttgtcccctggg

SEQ ID NO: 23028 - RNA, 651 nt, synthetic construct
  misc_feature 1..651: note = derived and/or modified sequence opt3 from Bimagrumab_LightChain1
  source 1..651: mol_type = other RNA
cagagcgccctgacccaacccgcttccgtgtctggctcacctgggcagagtatcacaattagctgcactggaacgtcctctgacgtcggttcgtacaactatgttaattggtaccagcagcacccaggcaaggcaccgaaactcatgatatatggggtgtcaaagagacccagcggagtaagtaacaggttctccggctctaaaagcggtaataccgcctcccttacaatctcagggctgcaagcggaggatgaagctgactactattgtggaacttttgccggcggcagttactatggggtgttcggaggtggcaccaagttgacagtcttagggcagcctaaagcagccccaagcgtgaccctgtttcccccttcttccgaggaactacaggctaacaaggcaactctcgtttgcctgatttcagatttctacccaggagccgtgacagtcgcttggaaggccgacagcagtcccgtgaaagcgggcgtagagaccacgactccttctaagcagtccaataacaaatacgcagccagctcgtatctttctctgaccccagaacaatggaagtcccatcggtcatacagttgtcaggttacacacgagggtagcactgtggagaaaaccgtcgctccgacagaatgctcc

SEQ ID NO: 23029 - RNA, 1365 nt, synthetic construct
  misc_feature 1..1365: note = derived and/or modified sequence opt3 from Bimekizumab_HeavyChain1
  source 1..1365: mol_type = other RNA
gaggtgcagctggtcgaaagcggcgggggactcgttcaacccggtggctcccttagactgtcttgcgccgcttcagggttcacctttagtgactacaacatggcatgggtgaggcaggcccctggaaagggcttggagtgggtagcgacaatcacttatgaaggtcggaatacgtactatcgcgatagcgtgaaagggcgattcaccatttcccgtgacaacgctaaaaattctttatacctgcagatgaactcgctaagagccgaggatacagcagtctattactgtgcctcaccaccgcagtattacgaaggaagcatatacaggctctggtttgctcactggggccaaggcactctggtgaccgttagttccgcatctacaaaggggcccagcgtgttccctcttgccccatcctcaaagagtaccagcggaggtactgctgccctgggctgcttggtcaaagactattttcccgagcctgtgacagtatcttggaactccggggcgctcacctcaggagttcatacgttcccagcagtgctgcagagcagtggcctgtactctctctccagcgtcgtgactgtgccctcgtcttccttaggtacccagacatatatctgtaatgtcaatcacaagccttcaaacactaaggttgataaaaaggtggagccaaaaagttgcgacaagacccatacatgtccgccctgccctgccccagaactgcttgggggacccagcgtatttttgttccctccaaaacccaaggataccctgatgatttcccggacgccggaggtgacttgtgtcgtggttgacgtgtctcacgaagatcctgaggtcaagtttaattggtacgtggacggcgtagaggttcataacgctaaaacaaagccccgcgaggaacagtataatagcacctacagagtggtctcagtgctaactgtcctccaccaagattggctgaacggcaaagaatataagtgcaaagtgagtaataaggcccttccagcacctatcgagaaaacaatttccaaggctaaggggcagcccagggaaccacaggtttacaccctgccccctagccgggacgagttgacgaaaaaccaggtgtctctcacctgtctggtaaagggattctacccatcagatatcgccgtcgagtgggaaagtaatggtcaaccggagaacaactataaaacaactccccctgtgttagacagcgacggctcctttttcctgtactctaagctcaccgttgataaatcgcgctggcagcaggggaatgtgtttagctgctccgtcatgcacgaagcgcttcataaccactatacacaaaagtcactgagtttgtctccaggaaag

SEQ ID NO: 23030 - RNA, 642 nt, synthetic construct
  misc_feature 1..642: note = derived and/or modified sequence opt3 from Bimekizumab_LightChain1
  source 1..642: mol_type = other RNA
gccatccagctgacccaaagcccctcctctctctcagctagtgtgggcgacagagtcacaattacttgcagggcagatgagagcgttcggacgcttatgcactggtaccagcagaagcctgggaaagccccaaagctgttgatatatttagtgtccaactctgaaatcggagtaccggaccgcttctcgggttcaggcagcgggaccgattttcgactgacaattagttccctacagcccgaggacttcgcgacttactattgtcaacagacctggtctgatccttggacatttggacagggcaccaaagtggaaatcaagcgtactgtcgctgccccaagcgtgttcatttttcccccttccgacgagcagctcaaatcaggtacagcaagtgttgtgtgcctgcttaataacttctacccaagagaagccaaggtccaatggaaggtggataatgctctgcagagcgggaactctcaggagtccgtaaccgagcaggactcaaaagatagcacgtatagtttgtcttccactctcaccctgagcaaggcagactacgaaaaacataaggtttatgcctgtgaggtgacacaccaaggactgtcgtctcccgtcactaaatcctttaataggggcgaatgc

SEQ ID NO: 23031 - RNA, 1344 nt, synthetic construct
  misc_feature 1..1344: note = derived and/or modified sequence opt3 from Bleselumab_HeavyChain1
  source 1..1344: mol_type = other RNA
cagctgcaactccaggagagcggccccgggcttctgaagccttccgaaaccttgtctttaacatgcactgtgtcaggaggtagtatcagctccccaggctactatgggggatggattagacagccgcccggcaaaggtctggagtggatagggtctatctacaagtcgggatcaacgtatcacaaccctagcctaaaaagtagggtcaccatttccgttgacacatctaagaatcagttcagcctcaaactgtcctcagtgactgccgctgataccgcagtatactattgtacacggccagtggtccgctactttggctggttcgacccctggggccaagggacccttgtgactgttagtagcgcctctacaaagggaccttccgtgtttccactggcgccctgctcacgaagcaccagtgaatctacggctgccttgggttgtctcgtcaaggattatttccctgagccagtgactgtatcctggaacagcggcgcactgacctcgggggttcatacatttccggccgtgctgcagtcttccggactctactcattaagtagcgtcgtgactgtgccctcctctagcctgggcaccaaaacatacacatgcaatgtcgaccacaagccttcaaacacgaaagttgataagcgtgtggaaagtaaatatggtccaccctgtcctccatgccccgctccggagttcgaagggggaccttccgtatttctttttcccccaaagcctaaggacactttgatgatcagcagaacacccgaagtgacctgtgtcgtggttgatgtgtctcaggaggacccagaagtccagttcaattggtacgtggatggcgtagaggttcataacgcaaaaactaagcccagggaggaacaattcaattcaacatatcgggtggtcagtgtgctgaccgtcctacaccaggactggctcaacggcaaagagtacaagtgcaaagtgagcaataaggggctgccttcctctattgagaaaacgatctcgaaggccaagggacagccacgcgagccgcaggtttatacccttccccctagccaagaagagatgaccaaaaaccaggtgtccctgacttgtttggtaaagggtttttacccatcagatatagctgtcgagtgggaaagtaatggccagcccgagaacaattataaaaccacacctccagtgctcgactctgatgggagcttctttctgtactccagattaactgttgacaagtcaaggtggcaagaaggaaacgtgttcagctgctctgtcatgcatgaggccctgcacaatcactacacccagaaatccctcagtcttagcctgggcaag

SEQ ID NO: 23032 - RNA, 639 nt, synthetic construct
  misc_feature 1..639: note = derived and/or modified sequence opt3 from Bleselumab_LightChain1
  source 1..639: mol_type = other RNA
gccatccagctgacccaaagcccctcctctctctcagctagtgtgggcgacagagtcacaattacttgcagggcaagccaggggatatcctctgcccttgcgtggtaccagcagaaacctggaaaagctccaaagctgttgatctatgatgcctcgaacttagagtcaggtgttccgagccggttcagtggctccgggtctggaacggactttaccctgacaattagctccctacaacccgaagatttcgcaacttactattgtcagcagtttaattcataccctaccttcggccagggtacaaaagtggagatcaagcgcaccgtagccgctccaagtgtgtttatttttccccctagcgacgaacaactcaaatctgggactgcatccgtcgtgtgcctgcttaacaatttctatccacgagaggccaaggttcagtggaaggtggataacgctctgcagtcaggaaatagccaggaaagtgtcacagagcaagactctaaagattccacctacagcttgtcgtctacgctcactctgtccaaggccgactatgagaaacacaaggtgtacgcgtgtgaagtaacccatcagggcctgtcaagtcccgttacaaagagcttcaaccgtggcgagtgc

SEQ ID NO: 23033 - RNA, 1512 nt, synthetic construct
  misc_feature 1..1512: note = derived and/or modified sequence opt3 from Blinatumomab_HeavyChain1
  source 1..1512: mol_type = other RNA
gacatccagctgacccaaagccccgcctccctcgctgtgtctcttggccagagagcaacaatttcatgcaaggccagtcagagcgtcgattacgacggggattcctatctgaactggtaccagcaaatacctggacagccaccgaaattgttaatctatgacgcgtctaatctggtttcgggtattccccctaggttctcaggcagcgggagtggaactgattttacgctaaacatccacccagtggagaaggtagacgctgccacctaccattgtcagcagtccacagaagatccctggactttcggcggtgggaccaaactcgagattaagggaggcggcgggtctggaggtggcgggagcggaggcggtgggtcccaagtgcagctgcagcagtcaggagcagaacttgtccggcctggcagtagcgtgaaaatctcttgcaaggcctccggctatgctttttcaagctactggatgaattgggttaagcaacgcccagggcagggactggagtggataggtcagatctggcccggcgacggggatacaaactataatggaaaattcaagggcaaagcaaccttgactgccgacgaaagttcttccacagcttacatgcaactcagctcgctggcctctgaggattccgcggtgtacttttgtgcacgacgtgagaccacgactgtcggtagatattactatgccatggactactgggggcagggcaccacagtgactgtatcaagtggaggcgggggaagcgatattaagctgcagcagtccggtgctgaactcgccaggcctggcgcatctgttaaaatgagctgcaagacctcagggtatacattcacccggtacacgatgcactgggtgaagcaacgcccaggacagggcttagagtggatcggttatattaacccgagtagagggtacactaattacaaccagaaatttaaggacaaagctacactgaccactgacaagtccagctctacagcctatatgcagctttcaagtttgaccagcgaagattccgcggtctactattgtgccaggtactatgacgatcattactgcctggactattggggccaaggaacgaccctaacagtgtcttcggtggagggcgggagcggaggttccggcgggtcaggaggcagtggtggggtcgatgacatccagctcactcagtctcccgcaataatgagcgcttcccctggcgagaaagttaccatgacatgtcgggcctcaagctctgtgtcctacatgaattggtaccagcaaaagagtggaactagcccaaaacgctggatttatgatacctctaaggtagcttccggcgtgccctaccgattctcagggagtggaagcggcacatcgtattccctgaccatctctagcatggaagccgaggacgcagccacttactattgccagcagtggtcaagtaaccctcttacgtttggtgctgggacaaagctggaattgaaacaccatcaccaccatcac

SEQ ID NO: 23034 - RNA, 1512 nt, synthetic construct; identical to SEQ ID NO: 23033
  misc_feature 1..1512: note = derived and/or modified sequence opt3 from Blinatumomab_SingleChain
  source 1..1512: mol_type = other RNA

SEQ ID NO: 23035 - RNA, 1512 nt, synthetic construct; identical to SEQ ID NO: 23033
  misc_feature 1..1512: note = derived and/or modified sequence opt3 from Blinatumumab_SingleChain_variable_fragment_fusion_protein_( bite)
  source 1..1512: mol_type = other RNA

SEQ ID NO: 23036 - RNA, 1344 nt, synthetic construct
  misc_feature 1..1344: note = derived and/or modified sequence opt3 from Blontuvetmab_HeavyChain
  source 1..1344: mol_type = other RNA
caggtgcaactgcagcagagcagagccgagctcgtcaggcccggcgcttccgttaccctttcttgcaagccttcagggtacacattcactgactatgaagtgcactgggtaaaacagacgccagtgcatggactggagtggatcggtgcaattgatccggaaaccggcgggacagccgacaaccaaaagtttaaaggaaaggcgatattgactgctgataaaagtagctccaccgcctacatggagttacggtctctgacatcggaagactcagcagtctattactgtaccaatttcgtggatgtttggggcactggtacaaccgtgacggtcagcagtgcctccactaccgctccctctgtgtttcctctagcaccaagctgcgggtcccagtcaggaagtacagtagccctcgcttgtctggttagcggctatttccccgagcctgtgactgtctcttggaactccggctcacttaccagcggggtgcacacatttccaagtgtgctgcagtcttccggattgtacagcctctcgtctatggtcaccgttccctcctcacgctggcctagtgagacgttcacttgcaatgtggcccatccagcgagcaagacaaaggtagacaaaccggtgcccaagcgagaaaacggtcgtgtccctagaccacccgattgtcctaaatgcccagcacccgagatgctgggcgggccgtccgtgtttatcttccctcccaagccaaaagacaccctgctcattgccaggactcctgaagttacatgtgtggtcgtggatttagaccccgaggatccagaggtacagatctcttggtttgttgacggaaagcaaatgcagaccgctaagacgcagccccgggaggaacagttcaatggcacctatcgcgtggtcagcgtgctgcctattggtcaccaagattggcttaaagggaagcagtttacatgcaaagtcaacaataaggccttgccatcaccgatcgaaagaactataagtaaagcaaggggacaggctcatcaaccctccgtgtacgttctgcctccaagccgggaggaactatctaagaacaccgtgtcactcacatgtctgatcaaagacttctttccccctgacattgatgtagagtggcagagtaatggccagcaggagccagaaagcaagtaccgcactacacccccgcaacttgacgaggatggctcctatttcctgtactctaagttgtcggtcgacaaaagccgatggcagagaggggataccttcatctgcgccgtgatgcacgaagcgctccacaaccattatacccagaagtccctgtcacacagtcctggaaaa

SEQ ID NO: 23037 - RNA, 657 nt, synthetic construct
  misc_feature 1..657: note = derived and/or modified sequence opt3 from Blontuvetmab_LightChain
  source 1..657: mol_type = other RNA
gacgtggtcatgagccagtccccctcttcactggccgttagtgtgggcgagaaggtaaccatgagctgcaaatcctctcaatcgctcctttactcagggaaccagaagaattatctggcttggtaccagcagaaacctggacaaagcccaagattgttaatctattgggcaagtacaagggaatccggtgtgccggatcggttcactggctctgggagcggaacggactttaccctgacaatttcctcagtcaaggccgaggatctagcggtgttctactgtcagcagtattacaactatcccctcacttttggcggtgggacccacctgacagttcttggacagcctaaagctagtccaagcgtgaccctgtttcccccttcttccgaagagttgggcgccaataaggcaactctcgtctgcctgatatcagacttctacccaagcggcgtgacagtagcctggaaggctgatgggagtcccatcacccaaggagttgaaacgactaaaccttctaagcagtccaacaataaatacgcagccagctcgtatctgtctctcaccccagacaagtggaaatcccattcaagtttcagctgtttagtgacacacgagggttccactgtcgagaagaaggtggctccggccgaatgctct

SEQ ID NO: 23038 - RNA, 1332 nt, synthetic construct
  misc_feature 1..1332: note = derived and/or modified sequence opt3 from Blosozumab_HeavyChain1
  source 1..1332: mol_type = other RNA
caggtgcaactggtccagagcggcgctgaggttaagaaacccggggcttccgtgaaggtatcttgcaaagtgtcaggattccctatcaaggacacctttcagcactgggtcagacaggcaccaggtaaaggcctcgaatggatggggtggagtgatccggagattggagacacagaatacgccagcaagttccaaggcagggtgactatgacggaggatacctccacagacactgcgtatatggaactttcttcgctgcggtcagaggataccgctgtttactattgtgccacaggtgacaccacttacaagtttgatttctgggggcagggaacaaccgtgacggtcagcagtgcatccactaaaggcccctctgtgtttcctttggccccatgcagccgctccacctcagagagtacagctgcattaggctgtctggtaaaggactatttccccgaacctgttactgtgagctggaactctggggccctaacctccggagtccatacatttccagctgtgctccagtcaagcggtctgtacagtctttcttccgtggtcaccgttcccagctcgtctctgggcacgaaaacttatacatgcaatgtggatcacaagccttccaacaccaaagtagacaagcgagtggagtcaaagtacgggccaccgtgtcccccttgcccagcccccgagttcttgggaggccctagtgtctttctcttcccacccaaaccgaaggatactctgatgataagccgtacacctgaggtgacctgtgttgtggtcgacgtgtcccaggaggatcccgaagtacaatttaattggtacgttgacggtgtggaggtccataacgcgaaaacgaagccaagagaagaacagttcaattctacctatagggtggtcagcgtgctgacagttctccaccaggactggttaaacgggaaagaatacaagtgcaaagtgtcaaataagggactgcctagttccatcgagaagactattagcaaagcaaagggccagccccgggagccacaagtatatacccttcccccttctcaggaagagatgactaaaaaccaggtctcattgacatgtctggtgaagggcttttacccaagtgatatcgccgttgaatgggagagcaatgggcaaccggaaaacaattataaaaccacaccccctgtgctagactccgatggatctttcttcctctactcgcgcctgaccgtcgacaagagcagatggcaggagggtaacgtgttttcctgctcagtaatgcatgaggcccttcacaatcactatactcagaagagtctgtctttgagcctcggc

SEQ ID NO: 23039 - RNA, 642 nt, synthetic construct
  misc_feature 1..642: note = derived and/or modified sequence opt3 from Blosozumab_LightChain1
  source 1..642: mol_type = other RNA
gacatccagatgacccaaagcccctcctctctgtcagccagtgtgggcgatagagtcacaattacttgcaaggctagccaggacgttcacacggcagtggcctggtaccagcagaaacctgggaaggcgccaaaactccttatatattgggcttccaccaggtggacaggagtaccgtctcggttctcgggttcaggcagcgggactgattttaccctgacaatcagttccttgcaacccgaggacttcgccacctactattgtcagcagtactctgattatccttggacttttggaggcggtacaaaggtggaaattaaacgcaccgtcgcagccccaagcgtgttcatctttcccccttccgacgagcagttaaagtcagggacggctagtgttgtgtgcctgctaaacaatttctacccacgagaagcaaaggtccaatggaaagtggataacgccctccagagcggaaattctcaggagtccgtaactgaacaggactcaaaggatagcacctatagtctgtcttccacacttactctgagcaaagctgactacgagaagcataaagtttacgcctgtgaggtgacccaccaaggcttgtcgtctcccgtcacaaagtcctttaaccgtggcgaatgc

SEQ ID NO: 23040 - RNA, 1332 nt, synthetic construct
  misc_feature 1..1332: note = derived and/or modified sequence opt3 from Bococizumab_HeavyChain1
  source 1..1332: mol_type = other RNA
caggtgcaactggtccagagcggcgccgaggttaagaaacccggggcttccgtgaaggtatcttgcaaagcatcaggatacaccttcacaagttattacatgcactgggtgagacaggcccctggtcagggcctcgaatggatgggggagatcagcccatttggaggcaggactaactataatgaaaagttcaaatcccgggtcacgatgacccgcgacacatctacttcgaccgtgtacatggagctttcaagcctgcgaagtgaagatacagcggtttattactgtgctcgtgagagaccgttgtatgcctccgacttatggggtcaagggaccactgtgacagtctctagcgcatccaccaagggaccctcagtgtttcctctggccccatgcagtaggagcacgtctgagtccactgctgcactaggctgtctcgtaaaggattacttccccgaacctgttaccgtgtcatggaacagcggcgccctgacaagtggggtccatacttttccagctgtgcttcagtcttccggactgtacagcttgtcgtctgtggtcaccgttccctcctcaaatttcggtacacagacctatacgtgcaacgtggaccacaaacctagtaatactaaggtagataaaacagtggagcggaagtgttgcgtcgaatgtccaccgtgccccgcccctccagtggcgggccccagcgtttttctcttccctccaaaacccaaggacaccctgatgatttcccgcactccggaggtgacatgtgtcgtggtagatgtttctcatgaggaccctgaagtgcagtttaactggtacgtcgatggggtggaggtccacaatgcaaagaccaaacccagagaggaacaattcaacagcacgtttagggtggtttcagtgctgaccgtagtccatcaggactggctcaatggaaaggaatataaatgcaaggtgagtaacaaaggcttaccatccagcatagagaagacaatctctaaaactaagggtcagcctcgggagccccaggtttacaccctgccaccctcacgcgaagagatgacaaagaatcaagtgagtcttacttgtttggtcaaagggttctatcctagcgatattgccgtggaatgggagtccaacggacagccagaaaataactacaagaccacaccgcccatgctggactctgatggctcgtttttcctatatagcaaactcaccgtagacaagtcccgatggcagcaaggcaatgtgttctcatgcagtgttatgcacgaggctctgcacaaccattacactcagaaatctcttagcctgtcccctgggaag

SEQ ID NO: 23041 - RNA, 642 nt, synthetic construct
  misc_feature 1..642: note = derived and/or modified sequence opt3 from Bococizumab_LightChain1
  source 1..642: mol_type = other RNA
gacatccagatgacccaaagcccctcctctctgtcagccagtgtgggcgatagagtcacaattacttgcagggctagccaggggatatcctctgcactcgcctggtaccagcagaagcctggaaaagcgccaaaacttctgatctattcggcttcataccggtatacgggtgttccgagccgcttcagtggctccgggtctggaaccgactttacattcactattagctccttgcaacccgaggatatcgccacctactattgtcagcagcgatactcattatggcgtacatttggccagggtaccaaactggaaattaagagaactgtggcagcccctagtgtattcatctttccacccagcgacgagcaactaaaatctgggacagcttccgtggtctgcctcctgaacaatttctatcctagggaagcaaaggtgcagtggaaggttgataacgcccttcagtcaggaaatagccaggagagtgtgaccgaacaagactctaaagattccacgtacagcctgtcgtctactttgaccctctccaaggctgactacgagaaacacaaggtctatgcctgtgaggtgacacatcagggcctgtcaagtccagtaactaagagctttaaccggggcgaatgc

SEQ ID NO: 23042 - RNA, 1338 nt, synthetic construct
  misc_feature 1..1338: note = derived and/or modified sequence opt3 from Brentuximab_vedotin_HeavyChain1
  source 1..1338: mol_type = other RNA
cagatccaactgcagcagagcggccccgaggtggtcaagcctggggcctccgttaaaatttcttgcaaggcttcaggatacaccttcacagactattacataacttgggtgaaacagaagccaggtcaaggcctcgaatggatcgggtggatttatccgggaagtggcaacacgaaatacaatgagaagtttaagggtaaagcaacccttacagtagatactagctcctctaccgccttcatgcagctgtcgtcattgacaagcgaagacaccgcggtgtatttttgtgctaactacgggaattattggttcgcctactggggacagggcactcaggtcacagtgagtgcagcctccaccaagggcccctctgtttttcctttagctccaagctccaaatcaacgagtgggggaactgcagccctgggttgcctagtgaaggattacttccccgagcctgtcaccgtgagctggaactctggcgctctcacatccggggtacacacttttccagccgttctgcaatcaagcggactttatagtctgtcttccgtggtcaccgtgcccagctcgtctttgggcacacagacctacatctgtaatgtgaaccataaaccttccaatacgaaggtcgacaagaaagttgaaccaaagtcatgcgataaaactcacacatgtccgccctgccctgcgccagagctcctgggtgggcccagtgtgttcctgtttcctccaaagcccaaagacaccctcatgattagcagaactccggaggtaacatgtgtggtcgtggatgtttcccatgaagaccctgaggtgaagttcaactggtatgtcgatggagtggaagtacacaatgcaaaaaccaagcccagggaggagcagtacaactctacgtatcgggttgtgagcgtcttaaccgtgctgcatcaggactggcttaatggcaaggaatacaaatgcaaggtctcaaacaaagccttgccagctcctatcgagaagacaataagtaaagccaagggccaaccccgcgaaccacaggtgtatactctgcccccttcccgagatgagctaaccaagaatcaggttagcctcacatgtctggtgaaagggttttacccatctgacatcgcagtagaatgggagtcaaacggacaaccggagaataactacaagactacaccccctgtccttgatagtgacggtagcttctttctgtattccaaattgaccgtggacaagtctcgttggcagcagggcaacgttttctcgtgcagcgtgatgcacgaagctctccacaatcattacacccagaaatccctgtcattaagtccaggg

SEQ ID NO: 23043 - RNA, 654 nt, synthetic construct
  misc_feature 1..654: note = derived and/or modified sequence opt3 from Brentuximab_vedotin_LightChain1
  source 1..654: mol_type = other RNA
gacatcgtgctgacccagagccccgcctccctcgctgtctctcttggccaaagagcaacaatttcatgcaaggccagtcagagcgttgatttcgacggggattcctacatgaactggtatcagcagaaacctggacaaccaccgaaggtgctgatatacgcggcttctaatttggagtcgggtatccccgccaggttttcaggcagcgggagtggaactgacttcacgttaaacattcaccctgtagaagaggaagatgcagccacctattactgtcagcagtccaatgaggacccatggacatttggcggtgggactaaactggaaatcaagcggaccgtggctgcaccctctgtcttcatttttcctccaagcgatgagcagctaaaatccggaacagcctcagtggtttgcctcctgaacaatttctatccccgcgaggctaaggtgcaatggaaggtcgacaacgcccttcagagtggcaatagccaggaatctgtgaccgagcaggattccaaagactcaacttacagcctgagttctacattgaccctctccaaggcggattatgaaaaacataaggtatacgcatgtgaggttacgcaccaaggcctgagctcgcctgtgactaaatcttttaaccgaggggagtgc

SEQ ID NO: 23044 - RNA, 1335 nt, synthetic construct
  misc_feature 1..1335: note = derived and/or modified sequence opt3 from Briakinumab_HeavyChain1
  source 1..1335: mol_type = other RNA
caagtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccttcatccgctatgacggttccaacaaatactatgcggattctgtcaaggggcgatttacaatttcgcgtgacaattctaaaaacactttgtacttacagatgaatagcctgagagctgaggatacggccgtgtattactgtaagacccatggaagtcacgacaactggggccaaggcacaatggttactgtgtcctctgcaagcaccaaagggccatccgtcttcccgctagccccctcaagtaagagcacatctggaggtaccgctgcactcggctgcctggtgaaggattattttcctgaaccagtaactgtttcctggaactcaggggcccttacaagcggagtgcataccttccccgctgtcctgcagagttctggcttgtactccctcagctcggtggtgacggtcccttcttcctcactgggtactcagacctacatatgtaatgttaatcacaaaccaagtaacacaaaggtggacaaaaaggtagagcccaaaagctgcgataagactcatacctgtcctccatgcccggcccccgaactgctcgggggaccttccgtgtttttattcccacccaagcctaaagacacactgatgatctctaggaccccagaggtcacgtgtgtggttgtggatgtcagccacgaggaccccgaagtgaagtttaattggtatgtagatggcgttgaggtgcacaacgcgaaaactaagccgcgggaggaacagtacaattcaacatatcgcgtcgtgagtgtccttaccgtgttgcatcaagactggctgaacggcaaagagtacaagtgcaaagtttccaataaggcactacctgcccccattgaaaagactatcagcaaagctaaggggcagccaagagagcctcaggtgtatacactgcccccatctagggaagagatgaccaaaaaccaggtatcactcacgtgtcttgtcaagggattctaccccagtgatattgccgtggaatgggagagcaatggtcaacctgagaacaactataaaaccacaccaccggttctggactccgacggctcatttttcttgtactcgaagctcactgtggataagagccggtggcagcaggggaatgtcttttcctgctcagtgatgcacgaagcactgcataaccactacacccagaaaagtttatctctgagccccggaaag

SEQ ID NO: 23045 - RNA, 651 nt, synthetic construct
  misc_feature 1..651: note = derived and/or modified sequence opt3 from Briakinumab_LightChain1
  source 1..651: mol_type = other RNA
cagagcgtgctgacccaacccccttccgtctctggcgccccagggcagagagttacaatctcatgcagtggaagcaggtccaacattggttctaatactgtgaagtggtaccagcagctcccgggcacggctcccaaacttctgatatattacaacgaccaacggccttcgggggtaccagatcgcttctcaggaagcaagagtggcacctccgcatctttggccatcacaggtttacaggcggaggacgaagctgattattactgtcagagctatgaccgatacactcaccccgccctgctatttgggaccggaacaaaagtgaccgtcctcggccagcctaaggcagccccatccgtgactctgtttcccccttcaagtgaggaacttcaagctaataaagcaacactggtttgcttgattagcgatttctatccaggcgccgtgaccgtcgcttggaaggccgactcttccccggtgaaggcgggggtagagacgactaccccctcaaaacagagcaacaataagtacgcagccagttcttacctctccctgacacctgaacagtggaaaagccatcgttcgtattcttgtcaggttactcacgagggatccaccgtggagaagacagtcgctccaaccgaatgctca

SEQ ID NO: 23046 - RNA, 1326 nt, synthetic construct
  misc_feature 1..1326: note = derived and/or modified sequence opt3 from Brodalumab_HeavyChain1
  source 1..1326: mol_type = other RNA
caggtgcaactggtccagagcggcgccgaggttaagaaacccggggcttccgtgaaggtatcttgcaaagcatcaggatacaccttcacaagatatggtatcagttgggtgaggcaggcccctggccaggggctcgaatggatgggatggattagcacttactccggcaacacgaattatgcgcaaaaacttcagggtcgggtcaccatgacaactgacacctctacatcgaccgcttacatggagctgcgctcattgcgaagcgatgacactgccgtgtattactgtgcacgtagacagttatattttgattactgggggcagggaacactggttaccgtgagttccgcctctacgaagggcccaagcgtcttcccgctagctccctgctccaggtcaaccagtgaaagcactgcagccctcggctgtctggtgaaggactactttcctgagccagtaacagtttcttggaactccggggctcttacttcaggagtgcacaccttccccgccgtcctgcaaagcagtggtttgtattctctctccagcgtggtgacagtcccttcgtctaattttggcacccagacgtacacttgcaacgttgatcataagccatccaatacaaaagtggacaagaccgtagaacggaaatgttgcgtggagtgtcccccttgcccagcgccgcccgtcgcagggccttcagtgttcctgtttccacccaagcctaaagatactctgatgataagtcgcacaccagaggttacctgtgtggtcgtggacgtaagccacgaagatcccgaggttcagttcaactggtatgtggacggagtcgaagtgcataatgccaagacgaagccgagagaggagcagtttaactccaccttcagggtcgtgtctgttctcacagtggtacaccaagattggttaaatggcaaagaatacaagtgcaaagtcagcaacaagggtctgcctgctcccatcgagaaaactatttcaaagaccaaagggcagccacgggaacctcaggtgtatacacttcccccaagtcgcgaggaaatgactaagaatcaagtttccttgacctgtctggtgaagggattttaccccagcgacatcgccgtcgagtgggagtctaacggccagcctgaaaataactataaaacaaccccaccgatgctagattcagacggcagtttctttctctacagcaagctgactgtggacaaatcccgatggcagcaggggaatgtattctcttgctcggtgatgcatgaggcacttcacaaccactacacgcaaaagagcctgtccttgtcacccggaaaa

SEQ ID NO: 23047 - RNA, 642 nt, synthetic construct
  misc_feature 1..642: note = derived and/or modified sequence opt3 from Brodalumab_LightChain1
  source 1..642: mol_type = other RNA
gagatcgtgatgacccagagccccgccacactgtccgtctctcctggcgaaagagctactctctcatgcagggcaagtcaaagcgtttcctctaaccttgcctggttccagcagaagccagggcaggcgccgcggcccctgatttacgacgcttcgacgcgcgccaccggagtgcctgcacgattttcaggtagcggcagtgggacagatttcactttgaccatatcctctttacaaagcgaggactttgccgtatattactgtcagcagtatgataattggccactgacattcggaggcggtaccaaagtggaaatcaagcgtactgtcgctgcaccctccgtgtttattttccctccatcagacgagcagctaaaaagtgggacagccagcgttgtgtgcctcctgaacaatttttaccccagagaagctaaggtccaatggaaagtggataacgcccttcagtctggaaattcccaggagtcagtaaccgagcaggacagcaaggatagtacgtattctctgtccagcactttgaccctctcgaaggcggactacgaaaaacacaaggtttatgcatgtgaggtgacacatcaaggcctgtcttcccctgtcactaaatcattcaacaggggcgaatgc

SEQ ID NO: 23048 - RNA, 756 nt, synthetic construct
  misc_feature 1..756: note = derived and/or modified sequence opt3 from Brolucizumab_HeavyChain1
  source 1..756: mol_type = other RNA
atggagatcgtgatgacccagagcccctccacactgtctgcctcagtcggcgacagagttattataacttgccaagctagtgaaatcattcacagctggctcgcatggtaccagcagaagcctgggaaagccccaaaacttctgatctatttggcgtccacgttagcttctggagtgccgtcgaggttctcaggtagcggcagtggggccgagtttaccctgacaatttcctctctacagcccgatgacttcgcaacttactattgtcaaaacgtatacctcgccagcaccaatggagctaactttggccagggtacaaagctgaccgtgcttgggggaggcggcgggtccggaggtggcgggtcaggaggcggtgggagtggaggcggcgggagcgaagtccagctggtggagtctggaggtggcttggttcagcctgggggatccctccggctgtcatgcactgcaagcggcttcagtctgacagattattactatatgacctgggtgcgccaagccccaggtaaggggctcgaatgggtcggctttatcgaccccgatgacgatccttactacgctacgtgggccaaaggacgattcactatatctcgtgacaattccaagaacaccttatatctgcagatgaatagccttagagcggaggatacagcagtgtactattgtgccggcggggaccataactcgggatggggtttggatatctggggccaggggactctggtaaccgtttcttcc

SEQ ID NO: 23049 - RNA, 756 nt, synthetic construct; identical to SEQ ID NO: 23048
  misc_feature 1..756: note = derived and/or modified sequence opt3 from Brolucizumab_scFv_fragment
  source 1..756: mol_type = other RNA

SEQ ID NO: 23050 - RNA, 1341 nt, synthetic construct
  misc_feature 1..1341: note = derived and/or modified sequence opt3 from Brontictuzumab_HeavyChain1
  source 1..1341: mol_type = other RNA
caggtgcaactggtccagagcggcgccgaggttaagaaacccggggcttccgtgaagatctcttgcaaagtatcaggatacaccctcagaggttattggattgaatgggtgaggcaggcacctggcaaggggcttgagtggataggacagatcctgccaggcacaggtcggactaactacaatgaaaaattcaaggggcgcgtcacgatgaccgccgacacaagtactgataccgcgtatatggagttgagctccttacgatctgaagacacagctgtgtactattgtgcccgttttgatggaaactacggctattacgcaatggactactggggccaagggaccactgttacagtgtcgtcagccagcaccaagggaccgagtgtcttccccctggctccttgctccagatctacgagcgagtccactgcagccctaggttgtctcgtgaaagattattttccagagcccgtaaccgtttcatggaatagtggcgctctgacaagcggggtgcacactttccctgccgtccttcagtcttccggactgtactcattgagcagtgtggtgaccgtcccatcttccaactttggcacacagacctatacgtgcaatgttgaccataagcccagcaacactaaagtggataagacagtagaaaggaaatgttgcgtggagtgtcctccatgcccggcgccccctgtcgcaggtccatcggtgttcctctttccccctaagccaaaggacaccctgatgatttctcggactcccgaagttacatgtgtggtcgtggatgtatcccacgaggacccggaggttcagttcaattggtacgtggatggggtcgaagtgcataacgccaaaaccaagcctcgcgaggaacaatttaattcaacgttcagagtcgtgagtgttctgaccgtggtacaccaggactggctcaacggaaaagagtataagtgcaaagtcagcaataagggcttacccgctccaatcgagaaaacaatttccaagactaagggccagcctagggaaccccaggtgtacaccctgccaccctctcgggaggaaatgactaaaaaccaagttagccttacatgtttggtgaaggggttttatccttcagatatcgccgtcgagtgggaaagtaatggacagccagagaacaattacaaaaccacaccgcccatgctggactccgacggtagcttctttctatactctaagctcaccgtggataaatcacgctggcagcaaggcaacgtattcagttgcagcgtgatgcatgaagcactgcacaaccactatactcagaagtccctttctctgtcgcctgggaag

SEQ ID NO: 23051 - RNA, 645 nt, synthetic construct
  misc_feature 1..645: note = derived and/or modified sequence opt3 from Brontictuzumab_LightChain1
  source 1..645: mol_type = other RNA
caggccgtggtcacccaagagcccagcctgacagtttcccctggcgggactgtgacgcttacctgcagatcttcaacaggagctgtaactaccagtaactacgcaaattggttccagcagaagccaggtcaggccccgaggacactcatcggcgggaccaacaatcgggcgcccggagtgcctgctcgctttagcggctccctgttgggtgggaaagccgcattaactctgtctggagcccaaccagaagacgaggctgaatattactgtgcactatggtattcgaaccactgggtcttcggcggcgggacaaagctcaccgtgctgggacagcccaaagccgctccttcagttacgctttttccacccagcagtgaggaactgcaggccaataaggcgactttggtgtgcctcgtctccgatttctaccctggtgcagtgaccgtagcctggaaagctgacggctctccagttaaggtgggggtcgagacaactaagccgagcaaacagtccaacaataagtatgccgcatcaagttacctgagcctgacccccgagcaatggaaatctcatcgatcctattcatgtcgtgtgacacacgaaggaagcaccgtggagaagacggtcgctcctgccgaatgcagt

SEQ ID NO: 23052 - RNA, 1332 nt, synthetic construct
  misc_feature 1..1332: note = derived and/or modified sequence opt3 from BTT-1023_HeavyChain1
  source 1..1332: mol_type = other RNA
caggtgcaactggtcgagagcggcgggggagttgtgcagcccggtagatccctcaggctttcttgcgccgcttcaggcttcacctttttcagttacgcaatgcactgggtacggcagacacctgggaagggactggaatgggtggccgtcatctggtttgacggcagcaacgagaattatgtggattccgttaaaggtcgcttcactatttctcgagacaactcgaagaatacgttgtacttacagatgaacaccctgcgtgcggaagatacagctgtgtattactgtgccagagacgcatggtcatattttgattactgggggcaaggaactctagtcaccgtgagcagtgcctccacaaaaggcccatctgtattcccgctcgctccctgcagcaggtccacctcagagagtactgcagccctgggctgtcttgttaaggactattttcctgaaccagtgacagtcagctggaactctggggctctgacctccggagtgcatacgttccccgccgtgttgcagtcaagcggtctctacagtctgtcttccgtcgttactgtgcctagctcgtctctgggcaccaaaacatacacttgcaatgtagatcacaagccatccaataccaaggtggacaaacgggtcgagtcaaagtatgggcccccttgtccaccgtgccccgcgcctgagtttgcaggaggcccaagtgtgttcctctttccccctaaaccaaaggatacattaatgataagccgcacccccgaagttacgtgtgtggtcgtggacgtatcccaggaggatccggaagttcagttcaactggtacgtggacggtgtcgaggtgcataatgccaaaactaagcctagagaggaacaatttaactctacatatagggtcgtgagcgttctgaccgtgcttcaccaggattggttgaatgggaaggagtacaaatgcaaggtatcaaacaaaggactgcccagttccatcgaaaagactattagcaaagctaagggccagccacgggagcctcaggtctatacactacccccatctcaagaagagatgaccaaaaatcaggtgtcactcacgtgtctggttaagggcttctaccccagtgacatcgccgtggagtgggaaagcaacgggcagcctgagaataactataagaccacaccaccggtccttgactccgatggatctttctttctgtactcgcgcttgactgtggacaaaagccgatggcaagaaggtaacgtattctcctgctcagtgatgcatgaggcactccacaatcactacacccagaagagtctgtctttaagcctgggcaaa

SEQ ID NO: 23053 - RNA, 642 nt, synthetic construct
  misc_feature 1..642: note = derived and/or modified sequence opt3 from BTT-1023_LightChain1
  source 1..642: mol_type = other RNA
gtgatccagctgacccaaagcccctcctctctctcagccagtgtcggcgacagagttacaattacttgcagggctagccaggggatatcccgggcacttgcctggtaccagcagaaacctggaaaaggtccaaagctgttgatctatgatgcgtcttcgttagagtcaggcgtgccgagccgcttcagtgggtccggatctggcacggactttaccctgacaattagctccctacaacccgaagatttcgctacttactattgtcagcagtttaactcataccctctcaccttcggtgggggaacaaaagtagagatcaagcgaaccgtggccgcaccaagtgtctttatttttccccctagcgacgaacagctgaaatctggcactgcctccgtggtttgccttctgaataacttctatccacgtgaggctaaggtgcaatggaaggtcgataatgcattgcagtcaggcaacagccaggaaagtgtgacagagcaggactctaaagattccacctacagcctctcgtctacgctgactctgtccaaggccgactatgagaaacacaaggtatacgcttgtgaagttacccatcaagggctctcaagtcccgtgacaaagagcttcaatagaggagagtgc

SEQ ID NO: 23054 - RNA, 1341 nt, synthetic construct
  misc_feature 1..1341: note = derived and/or modified sequence opt3 from Burosumab_HeavyChain1
  source 1..1341: mol_type = other RNA
caggtgcaactggtccagagcggcgccgaagttaagaaacccggggcttccgtgaaggtatcttgcaaagcatcaggatacaccttcacaaaccactatatgcattgggtgagacaggcccctggtcagggcctcgaatggatggggatcattaatccaataagtggaagcacttccaacgcgcaaaagtttcagggcagggtcacgatgacccgggacacatctacttcgaccgtgtacatggagctttcaagcctgcgcagtgaagatacagctgtttattactgtgcccgagacatcgtggatgcattcgacttttggggtcaggggaccatggtcactgtgtcctctgccagcacaaaaggaccgtccgtattccccttggctccttcaagtaagagcacctctggcggcacggcagccttagggtgcctggttaaggattattttccagagcccgtgactgtctcctggaactcaggagctctaaccagcggtgtgcacacattccctgccgtgctccagagttctggcctgtactcccttagctcggtcgttactgtgccatcttcctcactggggacccaaacatatatttgtaatgtaaatcataaacccagtaacaccaaggtggacaaaaaggtcgaacctaaaagctgcgataagacgcacacttgtccaccgtgccccgcgcctgagttgctcggaggcccatccgtgtttctgtttccccctaagccaaaagacacactgatgatctctcgtacccccgaggttacttgtgtggtcgtggatgtaagccatgaagacccggaggttaagtttaattggtacgtggatggtgtcgaagtgcacaacgcaaaaacaaagcctagagaggagcagtacaattcaacctatagggtcgtgagtgttctcacggtgttacaccaggactggctgaacgggaaagaatacaagtgcaaagtatccaataaggcccttcccgctccaattgagaagaccatcagcaaagccaagggacagcctcgggaaccccaagtctatacattgccaccctctcgcgatgagctgactaaaaaccaggtgtcactaacctgtctcgttaagggcttctaccctagtgacatagcagtggaatgggagagcaatggccagccagagaacaattataaaacaactccgcccgtcctggactccgatgggtctttcttcctttactcgaagctgaccgtggacaagagcagatggcaacagggaaacgtattttcctgctcagtgatgcatgaggctttgcacaaccattatacacagaaaagtctctctctgagccctggtaag

SEQ ID NO: 23055 - RNA, 639 nt, synthetic construct
  misc_feature 1..639: note = derived and/or modified sequence opt3 from Burosumab_LightChain1
  source 1..639: mol_type = other RNA
gccatccagctgacccaaagcccctcctctctctcagctagtgtgggcgacagagtcacaattacttgcagggcaagccaggggatatcctctgcccttgtttggtaccagcagaaacctggaaaagcgccaaagctgttgatctatgatgcttcgtcattagagagcggtgtgccgagtcggttctccggctctgggagcggaacggactttaccctgacaatttcctcactacaacccgaagatttcgccacttactattgtcagcagtttaacgactacttcacctttggccctggtacaaaagtagatatcaagcgcaccgtggcagccccaagtgtcttcatttttccccctagcgacgagcagctcaaatctgggactgcttccgtggtttgcctgcttaataacttctatccacgagaagcaaaggtgcaatggaaggtcgataatgccctgcagtcaggaaacagccaggagagtgtgacagaacaggactctaaagattccacctacagcttgtcgtctacgctcactctgtccaaggctgactatgagaaacacaaggtatacgcctgtgaggttacccatcaaggcctgtcaagtcccgtgacaaagagctttaatcgtggcgaatgc

SEQ ID NO: 23056 - RNA, 1344 nt, synthetic construct
  misc_feature 1..1344: note = derived and/or modified sequence opt3 from Canakinumab_HeavyChain1
  source 1..1344: mol_type = other RNA
caggtgcaactggtcgagagcggcgggggagttgtgcagcccggtagatccctcaggctttcttgcgccgcttcaggcttcacctttagtgtatacgggatgaactgggtgcggcaggcacctggaaagggcctggaatgggtcgccatcatttggtatgacggtgataatcagtactatgcggacagcgtgaaagggcgcttcacaatatcccgagataactctaagaatactttgtacttacaaatgaacggactgcgtgctgaggacacggccgtttattactgtgcaagagatctaaggaccggcccatttgactattggggccaggggacactcgtgactgtctcgtcagccagcaccaaaggaccgagtgtgttccccctggctccttcctctaagagcacatccggtggcaccgcagcccttgggtgcctggtaaaagattactttccagaacccgttactgtgtcatggaatagtggagctttgacaagcggcgtccacaccttccctgccgtgctccagtcttccggtctgtactcactgagcagtgtggtcacggttccatcttccagcctcgggactcagacctatatctgtaacgtgaatcataagccctcgaacacaaaggtagacaaacgggtggagcctaagtcttgcgataaaactcacacctgtccaccgtgccccgcgcctgaattactgggaggcccatccgtctttctttttccccctaagccaaaagacacattgatgatttcacgcacccccgaggtgacgtgtgttgtggtcgatgtgagtcatgaggacccggaagtaaagttcaattggtacgttgatggcgtggaggtccacaacgcaaagactaaacctagagaggaacaatataatagcacatacagggtggtctccgtgctgaccgttctacatcaggactggctcaacgggaaggagtataaatgcaaggtgtctaataaagccctgcccgctccaatcgaaaagactattagcaaagccaagggacagcctcgggagccccaggtatacacacttccaccctcacgcgaagagatgaccaagaaccaagtcagtctgacgtgtttggtgaaaggtttctatccttccgacatcgcagttgaatgggagagcaatggccagccagagaacaactacaagaccacaccgcccgtgctcgattctgacgggtcatttttcctgtacagtaaattaactgtcgataagagccgatggcagcaaggaaatgtgttttcctgctctgtaatgcacgaagctctgcacaaccattatacccagaaatcgctcagcctttcccctggcaag

SEQ ID NO: 23057 - RNA, 1344 nt, synthetic construct; identical to SEQ ID NO: 23056
  misc_feature 1..1344: note = derived and/or modified sequence opt3 from Canakinumab_HeavyChain
  source 1..1344: mol_type = other RNA

SEQ ID NO: 23058 - RNA, 642 nt, synthetic construct
  misc_feature 1..642: note = derived and/or modified sequence opt3 from Canakinumab_LightChain1
  source 1..642: mol_type = other RNA
gagatcgtgctgacccagagccccgacttccaatccgtcacacctaaggaaaaagttactattacgtgcagagcctctcagtcaataggcagtagcctccactggtaccagcagaagccagatcaatccccgaaacttctgatcaagtatgcttctcagtcgttttcaggggtgcccagcaggttcagtggatccggttctggcaccgactttacattgactattaacagcttagaggcagaagatgccgcggcttactattgtcatcagtcctcaagtctgcctttcacctttgggccaggaacaaaagtagacatcaagcggaccgtggccgcacccagcgtcttcatttttcctccatctgatgagcagctaaagtccggcactgcctcagtggtttgcctcctgaataacttctacccccgcgaagctaaagtgcaatggaaggtcgacaatgcacttcagagcggtaacagtcaggagtctgtgacagagcaggattccaaagacagcacctattcgctgtcttccacgttgactctctcaaaggccgattacgaaaaacacaaggtatatgcttgtgaggttacccatcaagggctgagtagccctgtgacaaagtcctttaatcgaggagaatgc

SEQ ID NO: 23059 - RNA, 642 nt, synthetic construct; identical to SEQ ID NO: 23058
  misc_feature 1..642: note = derived and/or modified sequence opt3 from Canakinumab_LightChain
  source 1..642: mol_type = other RNA

SEQ ID NO: 23060 - RNA, 1182 nt, synthetic construct
  misc_feature 1..1182: note = derived and/or modified sequence opt3 from Canakinumab_LightChain_variant_8836_L
  source 1..1182: mol_type = other RNA
caggtgcaactggtcgagagcggcgggggagttgtgcagcccggtagatccctcaggctttcttgcgccgcttcaggcttcacctttagtgtatacgggatgaactgggtgcggcaggcacctggaaagggcctggaatgggtcgccatcatttggtatgacggtgataatcagtactatgcggacagcgtgaaagggcgcttcacaatatcccgagataactctaagaatactttgtacttacaaatgaacggactgcgtgctgaggacacggccgtttattactgtgcaagagatctaaggaccggcccatttgactattggggccaggggacactcgtgactgtctcgtcagccagcaccaaaggaccgagtgtgttccccctggctccttcctctaagagcacatccggtggcaccgcagcccttgggtgcctggtaaaagattactttccagaacccgttactgtgtcatggaatagtggagctttgacaagcggcgtccacaccttccctgccgtgctccagtcttccggtctggagatcgtgctgacgcagtcaccagactttcaaagcgtcactcccaaggaaaaggttaccattacatgtcgggcgagtcagtctatcgggtccagcctccattggtaccagcagaaacctgatcaatcgccaaagttactgattaaatatgcatctcagtccttctcaggagtgccgagtcgctttagcggctccggctctgggactgacttcacccttacaatcaacagcttggaggccgaggatgctgccgcatactattgccaccagtcaagttccctgccctttaccttcggacctggtacgaaggtagacataaaaagaactgtggctgccccaagcgtctttatctttcccccttctgatgaacaactaaagtcaggcacagcgagtgtggtttgtctcctgaataacttctacccaagggaggccaaggtgcagtggaaagtcgacaatgcacttcagagcgggaactcccaggaatctgtgaccgagcaagactcgaaggatagcacttattccctgtcaagtacattgaccctctctaaagctgactacgagaagcataaagtatatgcctgcgaagttacgcaccagggactgagctcccccgtgaccaagtcattcaatcggggcgagtgt

SEQ ID NO: 23061 - RNA, 1197 nt, synthetic construct
  misc_feature 1..1197: note = derived and/or modified sequence opt3 from Cantuzumab_HeavyChain1
  source 1..1197: mol_type = other RNA
atcgacaccacaactggcgagcccacgtacgcccagaagttccaagggagaattgcttttagcctggaaacctccgcatctacagcctatctccagataaaatcacttaagagtgaggatactgcgacctacttctgcgctaggcggggaccttataactggtactttgacgtgtggggtcagggcacaaccgtcactgttagctccgcctctacaaaagggccatcggtgttcccgctggcaccctcaagcaagagtacctccggaggcacggccgctttgggttgtttagtaaaagattattttcctgaaccagtgactgtctcttggaatagcggggcactgacctccggagtgcacacattccccgccgttctacagtcaagtggcctctacagcctgtcttccgtggtcactgtgccttcaagcagtcttggcacccaaacatatatctgcaacgtaaatcataagccatctaacaccaaggttgacaaaaaggtggagcccaaatcctgtgataagacgcacacttgccctccatgtccggctcccgaactgcttgggggacctagcgtctttctcttcccacccaaacctaaggacacactgatgatttcgcgcaccccagaggtgacttgcgtggtcgttgatgtgtctcatgaggaccccgaagtaaagtttaattggtacgtggatggtgtcgaggtgcacaacgccaaaacaaagccgcgagaagaacagtacaattccacctatcgtgttgtgtcagtcctgacggtgctccatcaggactggttaaacggcaaagagtacaagtgtaaagtaagtaataaggcgctgcctgcacccatcgagaaaaccattagcaaggccaaggggcagccaagagagcctcaagtttatacacttcccccatccagggatgaattgactaaaaaccaggtgtctctgacctgcctagtcaagggattctaccccagcgacatcgctgtggagtgggaatcaaatggccagcctgagaacaattataaaacaactccaccggtcctcgatagtgacggttcctttttcctgtacagcaagttgaccgtggacaaatctcggtggcagcaagggaacgtttttagctgtagtgtgatgcacgaggccctgcacaatcattatacacagaagtcattgtccctctctcccggaaag

SEQ ID NO: 23062 - RNA, 1347 nt, synthetic construct
  misc_feature 1..1347: note = derived and/or modified sequence opt3 from Cantuzumab_HeavyChain
  source 1..1347: mol_type = other RNA
caggtgcaactggtccagagcggcgccgaggttaagaaacccggggaaaccgtgaagatctcctgcaaggcttctgactacacattcacttattacggaatgaactgggtaaaacaggcacctggtcagggcctcaaatggatggggtggattgatacgaccacaggagagccaacttatgcccaaaagtttcagggcagaatagcgttctcacttgaaaccagtgctagcacagcctacctgcagatcaagtccttgaaatctgaggacaccgcaacttatttttgtgccaggcggggtccgtacaattggtatttcgatgtgtgggggcagggaacaaccgtcacggtgtcgtcagctagcactaagggccccagtgtttttcctttagcaccatcctctaaaagcacctccggcgggacagccgctctgggatgcctagtgaaggactacttccccgaacctgtcactgtgtcatggaacagtggtgccctcaccagcggcgtacacacatttccagcggttctgcaatcttccgggctttactcactgagcagtgtggtcaccgtgccctcttccagcttgggaacgcagacttatatttgtaatgtgaaccataaaccttcgaatacaaaggtcgataagaaagttgagccaaagtcttgcgacaaaacccacacttgtccgccctgccctgcaccagagctcctgggcggtccctccgtgttcctgtttcctccaaagcccaaagatacactcatgatctcacgcaccccggaagtaacgtgtgtggtcgtggacgttagtcatgaggatcctgaagtgaagttcaactggtacgtcgacggggtggaggtacacaatgccaaaaccaagccccgagaggaacagtataacagcacataccgtgttgtgtccgtcttaactgtgctgcatcaggattggcttaatggaaaggagtataaatgcaaggtctctaacaaagccttgccagctcctattgaaaagaccatcagcaaagcaaagggccaacccagagagccacaggtgtacacactgcccccttcaagggacgaactaactaagaatcaggttagtctcacctgtctggtgaaaggcttttatccatccgatatagctgtagagtgggagagcaacgggcaaccggaaaataactacaagacaactccccctgtccttgactctgacggatcattctttctgtacagtaaattgaccgtggataagagccggtggcagcagggtaatgttttctcctgctctgtgatgcacgaggccctccacaaccattatacgcagaaatcgctgagcttatccccaggcaag

SEQ ID NO: 23063 - RNA, 657 nt, synthetic construct
  misc_feature 1..657: note = derived and/or modified sequence opt3 from Cantuzumab_LightChain1
  source 1..657: mol_type = other RNA
gacatcgtgatgacccagagccccctgtccgtccctgttacaccaggcgagccggtgtctatttcatgccggagtagcaagtccctccttcactctaacgggaatacttacctgtattggttcttgcaaaggcccggacagtcgcctcagttactgatataccggatgtcaaacctagtaagcggtgtgccagatcgctttagtggctccgggtctggaacggccttcaccctccgaatcagccgtgtcgaagctgaggacgtgggcgtttattactgtctgcagcatcttgaatatccctttacattcggtcctgggactaaactggagttgaagagaaccgtggcagccccatccgtctttatttttcccccttcagatgaacaactcaaaagtggaacagcgagcgtggtatgcctgctgaataacttctacccaagggaggctaaggttcagtggaaagtggacaatgccctccagtctggcaactcccaggagtcagtcaccgaacaagatagcaaggacagtacttattctttatccagcacactgaccctttcgaaggcagattacgagaaacacaaggtgtacgcctgtgaagtgacgcatcagggcttgtcttccccggtcactaaatcattcaatagaggggagtgc

SEQ ID NO: 23064 - RNA, 1344 nt, synthetic construct
  misc_feature 1..1344: note = derived and/or modified sequence opt3 from Cantuzumab_mertansine_HeavyChain1
  source 1..1344: mol_type = other RNA
gtgcagctggtccaaagcggcgccgaggttaagaaacccggggaaaccgtgaagatctcctgcaaggcttctgactacacattcacttattacggaatgaactgggtaaaacaggcacctggtcagggcctcaaatggatggggtggattgatacgaccacaggagagccaacttatgcccagaagtttcaaggcagaatagcgttctcacttgaaaccagtgctagcacagcctacctgcagatcaagtccttgaaatctgaggacaccgcaacttatttttgtgccaggcggggtccgtacaattggtatttcgatgtgtgggggcagggaacaaccgtcacggtgtcgtcagctagcactaagggccccagtgtttttcctttagcaccatcctctaaaagcacctccggcgggacagccgctctgggatgcctagtgaaggactacttccccgaacctgtcactgtgtcatggaacagtggtgccctcaccagcggcgtacacacatttccagcggttctgcagtcttccgggctttactcactgagcagtgtggtcaccgtgccctcttccagcttgggaacgcaaacttatatttgtaatgtgaaccataaaccttcgaatacaaaggtcgataagaaagttgagccaaagtcttgcgacaaaacccacacttgtccgccctgccctgcaccagagctcctgggcggtccctccgtgttcctgtttcctccaaagcccaaagatacactcatgatctcacgcaccccggaagtaacgtgtgtggtcgtggacgttagtcatgaggatcctgaagtgaagttcaactggtacgtcgacggggtggaggtacacaatgccaaaaccaagccccgagaggaacagtataacagcacataccgtgttgtgtccgtcttaactgtgctgcatcaggattggcttaatggaaaggagtataaatgcaaggtctctaacaaagccttgccagctcctattgaaaagaccatcagcaaagcaaagggccagcccagagagccacaagtgtacacactgcccccttcaagggacgaactaactaagaatcaggttagtctcacctgtctggtgaaaggcttttatccatccgatatagctgtagagtgggagagcaacgggcagccggaaaataactacaagacaactccccctgtccttgactctgacggatcattctttctgtacagtaaattgaccgtggataagagccggtggcaacagggtaatgttttctcctgctctgtgatgcacgaggccctccacaaccattatacgcagaaatcgctgagcttatccccaggcaag

SEQ ID NO: 23065 - RNA, 657 nt, synthetic construct; identical to SEQ ID NO: 23063
  misc_feature 1..657: note = derived and/or modified sequence opt3 from Cantuzumab_mertansine_LightChain1
  source 1..657: mol_type = other RNA

SEQ ID NO: 23066 - RNA, 1347 nt, synthetic construct; identical to SEQ ID NO: 23062
  misc_feature 1..1347: note = derived and/or modified sequence opt3 from Cantuzumab_ravtansine_HeavyChain1
  source 1..1347: mol_type = other RNA

SEQ ID NO: 23067 - RNA, 657 nt, synthetic construct; identical to SEQ ID NO: 23063
  misc_feature 1..657: note = derived and/or modified sequence opt3 from Cantuzumab_ravtansine_LightChain1
  source 1..657: mol_type = other RNA

SEQ ID NO: 23068 - RNA, 777 nt, synthetic construct
  misc_feature 1..777: note = derived and/or modified sequence opt3 from Caplacizumab
  source 1..777: mol_type = other RNA
gaggtgcagctggtcgaaagcggcgggggactcgttcaacccggtggctcccttagactgtcttgcgccgcttcagggaggaccttcagttacaaccctatgggatggtttcggcaggcaccaggcaagggtcgcgagttggtggccgcgatcagccgaacagggggatccacttattacccggactctgtagaaggccgtttcacgatttcgagagataatgctaaaaggatggtgtatttacagatgaactcactgcgggccgaggacaccgcagtctactattgtgccgctgcaggcgtgcgcgccgaagatgggagagttaggacactacccagcgagtacactttttggggacagggtacccaagtgacagtcagttccgctgccgcggaggtgcagctcgtagaatctggcgggggactggttcagcctggcggtagccttcggctgtcctgcgcagcctcagggcgcaccttcagttataatccaatgggatggtttcgacaggctcccggcaagggcagagagttggtggccgcaataagcaggactgggggatctacatactaccctgactccgtcgaaggtcggttcaccatctcacgtgataacgctaaacgcatggtgtatctccaaatgaatagcctgagagccgaggacacggcggtgtactattgtgccgcagctggcgtcagggccgaggatgggcgggttcgaactctgccaagtgaatacaccttttggggacagggcacacaggtgactgtatcttcc

SEQ ID NO: 23069 - RNA, 777 nt, synthetic construct; identical to SEQ ID NO: 23068
  misc_feature 1..777: note = derived and/or modified sequence opt3 from Caplacizumab_HeavyChain1
  source 1..777: mol_type = other RNA

SEQ ID NO: 23070 - RNA, 777 nt, synthetic construct; identical to SEQ ID NO: 23068
  misc_feature 1..777: note = derived and/or modified sequence opt3 from Caplacizumab_HeavyChain1
  source 1..777: mol_type = other RNA

SEQ ID NO: 23071 - RNA, 1347 nt, synthetic construct
  misc_feature 1..1347: note = derived and/or modified sequence opt3 from Carlumab_HeavyChain1
  source 1..1347: mol_type = other RNA
caggtgcaactggtccagagcggcgccgaggttaagaaacccgggtcctctgtgaaggtatcatgcaaagctagtggaggtaccttcagctcctacggcatctcttgggtgagacaggcacctgggcagggactcgaatggatgggcggtattataccaatctttgggacagccaactatgcgcaaaagttccagggaagggtcactattacggctgacgagtcgacctcaacagcctacatggaacttagcagtctgcggtccgaggatactgcagtgtattactgtgcccgctatgacggcatctacggcgaattggatttttgggggcagggaaccttagttacagtgtctagcgcttccaccaaaggtccgtcagtcttccccctggcacctagtagcaagtctacttccggcgggacagccgctctaggatgcctcgtgaaggactattttccagagcccgtaaccgtttcatggaatagcggcgccctgacgagtggtgtgcacactttccctgcggtccttcagtcttccgggctgtacagcttgtcgtctgtggtgaccgtcccatcctcaagtctcggaacacaaacttacatttgtaacgttaatcataaacccagcaacaccaaggtggataaaaaggtagagcctaaatcctgcgacaagacacacacctgtccaccgtgccccgcacctgaactgctgggcggcccatctgtgtttctctttccccctaagccaaaagatacgttaatgatcagccgaactcccgaggtcacatgtgtggttgtggacgtctcacatgaagatccggaggtgaagttcaattggtatgtagacggggttgaggtgcacaacgccaaaaccaagcctcgtgaggaacagtacaatagtacttatagagtcgtgtccgtcctgacagtgcttcatcaggattggttgaacggaaaagaatacaagtgcaaagttagcaataaggctctgcccgccccaatagagaagaccatctctaaagcaaagggtcagcctagggaaccccaagtgtatacgctaccaccctcacgggacgagctcaccaaaaaccaggtaagtctgacatgtcttgtcaagggcttctaccctagcgatattgctgtggagtgggaatccaatgggcagccagagaacaattataaaactaccccgcccgttctggactctgacggatcgtttttcttgtacagcaagctcacagtggataagtcccgctggcaacagggcaacgtcttttcatgcagtgtgatgcacgaagccctgcacaatcattacactcagaaatctttaagcctgtcccctggtaag

SEQ ID NO: 23072 - RNA, 648 nt, synthetic construct
  misc_feature 1..648: note = derived and/or modified sequence opt3 from Carlumab_LightChain1
  source 1..648: mol_type = other RNA
gagatcgtgctgacccagagccccgccacactctccctttctcctggcgaaagagctactctgtcatgcagggcaagtcaaagcgtctccgacgcctacttggcgtggtatcagcagaagccagggcaggctccgcggttactgatttacgatgcctcttcgcgcgcaacgggagttcccgcccgattctcaggtagcggcagtgggaccgactttacactaactatatcctctctcgagcctgaagatttcgctgtgtattactgtcaccaatatatccagctgcatagctttaccttcggacagggcacaaaagtagagattaagcgtaccgtggcagccccatccgtctttatctttcccccttcagacgaacagcttaaaagtggtactgctagcgtggtttgcctgttgaacaatttctacccaagagaggccaaggtgcaatggaaagtcgataacgcgctccagtctggaaattcccaggagtcagtgacagaacaggacagcaaggatagtacctattctctgtccagcacgctgactctctcgaaggcagactacgagaaacacaaggtatacgcctgtgaagttacccatcaagggttatcttcccccgtgacaaaatcattcaacaggggcgagtgc

SEQ ID NO: 23073 - RNA, 1353 nt, synthetic construct
  misc_feature 1..1353: note = derived and/or modified sequence opt3 from Cergutuzumab_amunaleukin_HeavyChain1
  source 1..1353: mol_type = other RNA
caggtgcaactggtccagagcggcgccgaggttaagaaacccggggcttccgtgaaggtatcttgcaaagcatcaggatacaccttcacagaatttggtatgaactgggtgagacaggcccctggccaggggctcgagtggatgggatggatcaatactaagacgggcgaagcgacctatgtcgaggagttcaaaggtagggtgacatttactaccgacacaagtaccagcactgcttacatggagcttcggtccctgcgctctgatgacacagccgtttattactgtgcacgatgggatttcgcctattacgtggaggctatggactattgggggcaaggaaccacggtcactgtgtcgtcagcaagcaccaagggcccaagtgtatttccgttggccccctcctctaagagcacatccggcgggactgctgccttaggatgcctggttaaagattacttccctgaaccagtgaccgtctcatggaacagtggtgcgctaacaagcggcgtgcacacctttcccgcagtgctccagtcttccgggctgtactcacttagcagtgtcgttacggtgccttcttccagcctgggaactcagacatatatttgtaatgtaaaccataagccatcgaataccaaagtggacaagaaagtcgagcccaagtcttgcgataagactcacacatgtcctccatgcccggcccccgaagctgccggcggtccttccgtgttcttgtttccacccaaacctaaggacaccctcatgatatcacgtacgccagaggttacctgtgtggtcgtggatgtaagtcatgaggaccccgaagttaaattcaactggtacgtggatggggtcgaggtgcacaatgcaaagacaaaaccgagagaagaacagtataacagcacttacagggtcgtgtccgttctgaccgtgctgcatcaagactggctcaatggaaaggaatataaatgcaaggtatctaacaaggctttaggcgcccctatcgagaaaacaattagcaaggcgaaaggccagccccgggagccacaggtctgtactctgcctccctcacgcgatgaacttaccaagaatcaggtgagtttgtcctgcgccgttaaagggttttacccaagcgacatcgcagtggagtgggaatctaacggacaacccgagaataactataagacaacccctccagtcctggactcagatggtagtttctttctagtgagcaagctcactgtagacaaatccagatggcagcagggcaatgtgttctcttgttcggttatgcacgaagctctgcacaaccattacacgcaaaagagcctttccctgtcaccggggaaa

SEQ ID NO: 23074 - RNA, 1794 nt, synthetic construct
  misc_feature 1..1794: note = derived and/or modified sequence opt3 from Cergutuzumab_amunaleukin_HeavyChain2
  source 1..1794: mol_type = other RNA
caggtgcaactggtccagagcggcgccgaggttaagaaacccggggcttccgtgaaggtatcttgcaaagcatcaggatacaccttcacagaatttggtatgaactgggtgagacaggcccctggccaggggctcgagtggatgggatggatcaatactaagacgggcgaagcgacctatgtcgaggagttcaaaggtagggtgacatttactaccgacacaagtaccagcactgcttacatggagcttcggtccctgcgctctgatgacacagccgtttattactgtgcacgatgggatttcgcctattacgtggaggctatggactattgggggcaaggaaccacggtcactgtgtcgtcagcaagcaccaagggcccaagtgtatttccgttggccccctcctctaagagcacatccggcgggactgctgccttaggatgcctggttaaagattacttccctgaaccagtgaccgtctcatggaacagtggtgcgctaacaagcggcgtgcacacctttcccgcagtgctccagtcttccgggctgtactcacttagcagtgtcgttacggtgccttcttccagcctgggaactcagacatatatttgtaatgtaaaccataagccatcgaataccaaagtggacaagaaagtcgagcccaagtcttgcgataagactcacacatgtcctccatgcccggcccccgaagctgccggcggtccttccgtgttcttgtttccacccaaacctaaggacaccctcatgatatcacgtacgccagaggttacctgtgtggtcgtggatgtaagtcatgaggaccccgaagttaaattcaactggtacgtggatggggtcgaggtgcacaatgcaaagacaaaaccgagagaagaacagtataacagcacttacagggtcgtgtccgttctgaccgtgctgcatcaagactggctcaatggaaaggaatataaatgcaaggtatctaacaaggctttaggcgcccctatcgagaaaacaattagcaaggcgaaaggccagccccgggagccacaggtctacactctgcctccctgtcgcgatgaacttaccaagaatcaggtgtcattgtggtgcctggttaaagggttttatccaagtgacatcgccgtggagtgggaatccaacggacaacccgagaataactacaagacaacccctccagtcctagacagcgatggttctttctttctctactcaaagctgactgtggacaaaagtagatggcagcagggcaatgtattcagctgttccgtgatgcacgaagcacttcacaaccattatacgcaaaagtctctgtcgttgagcccagggggaggcggtgggtccggcggaggcgggtcaggaggtggcgggagtgctcccgcctctagctccaccaaaaagacacagctccagctggagcacttactgctcgatcttcagatgattctgaacggaatcaataactacaaaaatcctaagttgactaggatgctaaccgctaagttcgccatgccgaaaaaggcaacagagctgaaacatctccaatgcctggaagaggaacttaagcccctggaggaagttttgaacggcgcccagagcaaaaattttcacctccggcctcgcgacctgatatcaaacatcaatgtcattgtgttagagctgaagggttctgagaccactttcatgtgcgaatatgctgatgagacagcgacgatcgtggaatttctaaaccgatggattaccttcgcacagtccatcataagtactctcaca

SEQ ID NO: 23075 - RNA, 645 nt, synthetic construct
  misc_feature 1..645: note = derived and/or modified sequence opt3 from Cergutuzumab_amunaleukin_LightChain1
  source 1..645: mol_type = other RNA
gacatccagatgacccaaagcccctcctctctgtcagccagtgtgggcgatagagtcacaattacttgcaaggctagcgcagccgttgggacgtacgtggcgtggtatcagcagaaacctggaaaggctccaaaactccttatatactccgcctcttataggaagcggggtgtaccgtcgcgcttctcaggcagcgggagtggaaccgactttacactgactatctcctctttgcagcccgaggatttcgcaacctactattgtcaccaatactatacataccctttatttaccttcggccagggtactaaactggaaattaagcgaacagtggccgctccaagcgtctttatctttcccccttccgacgagcagctaaagtcagggaccgcaagtgtggtttgcctcctgaacaatttctacccacgtgaagccaaagtgcagtggaaggtcgataacgcccttcaaagcggaaattctcaggagtccgtgacggaacaggactcaaaagatagcacttatagtctgtcttccaccttgacactcagcaaggctgactacgagaaacataaggtatatgcgtgtgaggttactcaccagggcctgtcgtctcccgtgaccaagtccttcaacagaggcgaatgc

SEQ ID NO: 23076 - RNA, 687 nt, synthetic construct
  misc_feature 1..687: note = derived and/or modified sequence opt3 from Certolizumab_pegol_HeavyChain1
  source 1..687: mol_type = other RNA
gaggtgcagctggtcgaaagcggcgggggactcgttcaacccggtggctcccttagactgtcttgcgccgcttcagggtacgtgttcaccgactatggaatgaactgggtaaggcaggcacctggcaagggtttggagtggatggggtggatcaatacatacattggagaaccaatatatgccgatagtgtgaaaggccggtttactttcagcttagacacgtccaagtctaccgcgtacctgcagatgaactcgctacgcgctgaggatacagccgtctattactgtgcacgaggctatcgttcatacgccatggactactgggggcagggaactctcgtgaccgttagcagtgcttccacaaaaggtccgtctgtgtttcccctggcacctagctccaagtcaaccagtggcgggactgccgctcttggatgcctggtcaaagattatttcccagaacccgtgacagtaagctggaactctggcgccttgacctccggtgttcacacgtttcctgcggtgctccaatcaagcgggctgtacagtctgtcttccgtcgtgactgtgccaagctcgtctctcggaacccagacatatatctgtaatgtcaatcataagccctccaacactaaggttgacaaaaaggtggagcctaaatcatgcgataagacccacacatgtgcagcc

SEQ ID NO: 23077 - RNA, 687 nt, synthetic construct; identical to SEQ ID NO: 23076
  misc_feature 1..687: note = derived and/or modified sequence opt3 from Certolizumab_pegol_HeavyChain
  source 1..687: mol_type = other RNA

SEQ ID NO: 23078 - RNA, 642 nt, synthetic construct
  misc_feature 1..642: note = derived and/or modified sequence opt3 from Certolizumab_pegol_LightChain1
  source 1..642: mol_type = other RNA
gacatccagatgacccaaagcccctcctctctgtcagccagtgtgggcgatagagtcacaattacttgcaaggctagccagaacgttgggacgaatgtggcatggtaccagcagaaacctggaaaggccccaaaagcgctcatatattccgcttctttcctttactcgggtgtaccgtataggttttcaggcagcgggagtggaaccgacttcacactgactatctcctctttgcaacccgaggattttgccacctactattgtcagcagtacaacatttatcctttaacattcggccagggtaccaaggtggaaatcaaacggactgtcgcagccccaagcgtgtttatttttcccccttccgacgagcaactgaagtcagggacagctagtgttgtgtgcctactcaataacttctacccacgcgaagcaaaggtccagtggaaagtggataatgccctgcagagcggaaactctcaggagtccgtaaccgaacaagactcaaaggatagcacgtacagtctttcttccactctgaccttgagcaaagctgactatgagaagcacaaagtttacgcctgtgaggtgacacatcagggcctctcgtctcccgtcactaagtccttcaatcgaggcgaatgc

SEQ ID NO: 23079 - RNA, 642 nt, synthetic construct; identical to SEQ ID NO: 23078
  misc_feature 1..642: note = derived and/or modified sequence opt3 from Certolizumab_pegol_LightChain
  source 1..642: mol_type = other RNA

SEQ ID NO: 23080 - RNA, 1356 nt, synthetic construct
  misc_feature 1..1356: note = derived and/or modified sequence opt3 from Cetuximab_HeavyChain
  source 1..1356: mol_type = other RNA
caggtgcaactgaagcagagcggccccgggctcgtccagccttcccagtctctttcaattacctgcacagttagtggattcagcctgactaactacggtgtgcactgggtaagacaatccccaggcaaagggttggagtggttaggagtgatctggtctggcggtaatacggactataacaccccgtttacatcgaggctgtcaataaataaggataacagcaaaagtcaggtcttctttaagatgaatagcctacagtctaacgacactgctatctactattgtgctcgggcactcacctactatgattacgagttcgcctattgggggcagggaacactggtgaccgttagcgcggcttccactaaaggcccctcagtgtttcctcttgccccaagtagcaagtctacatccggcgggaccgcagccctgggatgcttggtcaaggactacttccccgaacctgtgacggtatcatggaatagcggtgctctcacaagtggcgttcatacctttccagcagtgctgcaatcttccgggctgtacagcctctcgtctgtcgtgacagtgccctcctcaagtttaggaactcagacctatatttgtaacgtcaatcacaaacctagcaacacaaaggttgataaacgcgtggaaccaaagtccccgaaatcttgcgacaagacccatacgtgtcccccttgcccagcccccgagctgcttggcggtcctagcgtattcttgtttccacccaagccgaaagatactctgatgatctcacgaacacctgaagtgacctgtgtcgtggttgacgtgagtcacgaggatcccgaggtcaagttcaattggtacgtggacggggtagaagttcataacgctaaaactaagccacgtgaggaacagtataattccacatacagagtggtcagcgtgctaaccgtcctccaccaggattggctgaacggaaaagagtataagtgcaaagtgtctaataaggcccttcctgcgcccattgagaagacgatctcaaaagcaaagggccaaccaagggaaccccaggtttacaccctgcctccaagtcgggacgagttgactaaaaaccaggtgagcctcacttgtctggtaaagggcttttatccgtccgatatagccgtcgaatgggagtctaacgggcaacccgaaaataactacaaaaccacacctccagtgttagactcggacggatccttctttctgtactccaagctcactgttgataagtcacgctggcagcagggtaatgtgttcagttgctctgtcatgcacgaggcccttcataaccactatacccagaaaagcctgtccttgtcacccggcaag

SEQ ID NO: 23081 - RNA, 1347 nt, synthetic construct
  misc_feature 1..1347: note = derived and/or modified sequence opt3 from Cetuximab_HeavyChain_variant
  source 1..1347: mol_type = other RNA
caggtgcaactgaagcagagcggccccgggctcgtccagccttcccagtctctttcaatcacatgcacagttagtggattcagcctgactaactacggtgtgcactgggtaagacaatccccaggcaaagggttggagtggttaggagtgatttggtctggcggtaatacggactataacaccccgtttacatcgaggctgtcaataaataaggataacagcaaaagtcaggtcttctttaagatgaatagtctacagtctaacgacactgctatctactattgtgctcgggcactcacctactatgattacgagttcgcctattgggggcagggaacactggtgaccgttagcgcggcttccactaaaggcccctcagtgtttcctcttgccccaagtagcaagtctacatccggcgggaccgcagccctgggatgcttggtcaaggactacttccccgaacctgtgacggtatcatggaatagcggtgctctcacttccggcgttcatacctttccagcagtgctgcaatcttccgggctgtacagcctctcgtctgtcgtgacagtgccctcctcaagtttaggaactcagacctatatttgtaacgtcaatcacaaacctagcaacacaaaggttgataaaaaggtggaaccaaaatcctgcgacaagacccatacgtgtccgccctgccctgccccagagctgcttggcggtccctctgtattcttgtttcctccaaagcccaaagatactctgatgatcagccgcacaccggaagtgacctgtgtcgtggttgacgtgtcacacgaggatcctgaggtcaagttcaattggtacgtggacggggtagaagttcataacgctaaaactaagccccgagaggaacagtataatagtacataccgtgtggtctccgtgctaaccgtcctccaccaggattggctgaacggaaaagagtataagtgcaaagtgagcaataaggcccttccagcgcctattgagaagacgatctctaaagcaaagggccaacccagagaaccacaggtttacaccctgcccccttcaagggacgagttgaccaaaaaccaggtgagtctcacttgtctggtaaagggcttttatccaagcgatatagccgtcgaatgggagtccaacgggcaaccggaaaataactacaaaaccacaccccctgtgttagactctgacggatcgttctttctgtacagcaagctcactgttgataagtcccggtggcagcagggtaatgtgttctcatgcagtgtcatgcacgaggcccttcataaccactatacccagaaatctctgagcttgtccccaggcaag

SEQ ID NO: 23082 - RNA, 639 nt, synthetic construct
  misc_feature 1..639: note = derived and/or modified sequence opt3 from Cetuximab_LightChain
  source 1..639: mol_type = other RNA
gacatcctgctcacccagagccccgtgattctttccgtctctcctggcgagagagtttcattcagttgcagggccagccaatccatagggacaaacatccactggtaccagcagcggactaatggatctccacgcctgttgattaagtatgcttcggaatcaatcagcggtattccgagtcgattttccggctctgggagcggaacggatttcaccttatccatcaactcagtggagagtgaagacatagcagattactattgtcagcaaaataacaattggcccacaacttttggcgccggtaccaaactggagctaaagcgtacagtagcggctcctagcgtgttcatctttccaccctctgacgaacagctcaaatccgggaccgcctcagtcgtgtgcctgcttaacaatttctaccctagagaggcaaaggttcagtggaaagtggataacgccctgcagagcggaaatagtcaagagtctgtcactgaacaggactccaaggatagcacatattcgttgtcttccaccctcacgctgtcaaaggctgactacgagaaacataaggtgtatgcatgtgaagtaactcaccagggcctgagtagcccagttaccaaatcctttaacaggggcgcc

SEQ ID NO: 23083 - RNA, 642 nt, synthetic construct
  misc_feature 1..642: note = derived and/or modified sequence opt3 from Cetuximab_LightChain_variant
  source 1..642: mol_type = other RNA
gacatcctgctcacccagagccccgtgattctttccgtctctcctggcgagagagtttcattcagttgcagggccagccaatccatagggacaaacatccactggtaccagcagcggactaatggatctccacgcctgttgattaagtatgcttcggaatcaatcagcggtattccgagtcgattttccggctctgggagcggaacggatttcaccttatccatcaactcagtggagagtgaagacatagcagattactattgtcagcaaaataacaattggcccacaacttttggcgccggtaccaaactggagctaaagcgtacagtagcggctcctagcgtgttcatctttccaccctctgacgaacagctcaaatccgggaccgcctcagtcgtgtgcctgcttaacaatttctaccctagagaggcaaaggttcagtggaaagtggataacgccctgcagagcggaaatagtcaagagtctgtcactgaacaggactccaaggatagcacatattcgttgtcttccaccctcacgctgtcaaaggctgactacgagaaacataaggtgtatgcatgtgaagtaactcaccagggcctgagtagcccagttaccaaatcctttaacaggggcgagtgc

SEQ ID NO: 23084 - RNA, 675 nt, synthetic construct
  misc_feature 1..675: note = derived and/or modified sequence opt3 from Citatuzumab_bogatox_HeavyChain1
  source 1..675: mol_type = other RNA
caccatcaccatcaccatgaggtgcagctggtccaaagcggccccgggctcgttcagcctggaggttccgtgagaatctcttgcgccgcttcaggctacaccttcacaaactatgggatgaattgggtaaagcaggcaccaggaaaaggccttgaatggatgggttggattaacacttacacgggggagagtacctatgccgacagctttaagggaaggttcacattttccctggatacttctgcgtcggctgcctacttgcagataaattcattacgggcagaagacaccgccgtgtattactgtgctcgcttcgcaatcaaaggcgattattggggccaagggacactgctaaccgtcagcagtgcctccactaagggaccgtctgtgtttcccctcgctcctagctccaaatcaacaagtggtggcaccgccgcgctggggtgccttgttaaggactacttcccagagcccgtgacggtcagctggaactctggagcactgacttccggcgtgcacacctttcctgccgtattgcagtcaagcggtctctacagtctgtcttccgttgtgacagtcccaagctcgtctctggggactcagacctatatttgtaatgtgaaccacaagccctccaatacaaaagtggataagaaagtcgaacctaagtcatgc

SEQ ID NO: 23085 - RNA, 1443 nt, synthetic construct
  misc_feature 1..1443: note = derived and/or modified sequence opt3 from Citatuzumab_bogatox_LightChain1
  source 1..1443: mol_type = other RNA
gacatccagatgacccaaagcccctcctctctgtcagccagtgtgggcgatagagtcacaattacttgcaggagcacgaagtccctccttcactctaacgggataacctacctgtattggtaccagcagaaacctggaaaggctccaaaattgttaatctatcagatgtcgaatctggcatcaggtgttccgagccggttcagttcctctggcagcgggacagactttactctaaccatttcctcactccaacccgaggatttcgccacatactattgtgcgcagaacctggaaatccctcgcacctttggacagggcactaaggtggagcttaaacgaacagtagctgccccaagtgtgttcatttttccccctagcgacgaacagctgaagtctggtaccgcatccgtcgtgtgcttgctcaataacttctacccacgtgaggccaaggttcaatggaaagtggataatgctctgcagtcagggaacagccaggaaagtgtcacggagcaggactctaaggattccacttatagcctgtcgtctaccctcacattatccaaagcagactacgagaagcataaagtgtacgcctgtgaagtaactcaccaaggactgtcaagtcccgttaccaagagctttaatagaggcgagtgcacaaggcatcggcagcctcgcggctgggaacagctttataacaccgtgtccttcaatttgggggaggcttacgagtatccaacgtttatccaagatctgagaaacgaactagccaagggaactccggtctgtcagctccccgtgacactgcagaccatagcggacgataaaaggttcgtgcttgtcgacatcactacaacctctaagaaaacggttaaggtggcaattgatgtaaccgacgtgtacgtcgtgggttatcaggacaaatgggatggcaaggaccgggccgtttttctggataaagtgcctacagtcgctactagcaagttgttcccaggggtgaccaatcgcgtaacactcacttttgacggatcataccaaaagctggttaacgccgcaaaagctgatcgaaaggccttagagctgggcgtgaataaactcgagttcagtatcgaagcgattcacggtaagaccatcaacgggcaggaagccgcaaaattctttcttatagtcattcagatggtgtccgaggctgccagattcaagtatatcgagacagaagtcgtggacaggggactgtacggcagctttaagcccaatttcaaagttttgaacctagagaacaattggggcgatatttctgacgctatccataagtcaagtcctcagtgcaccactatcaacccagccctgcaactcattagcccctccaatgatccgtgggtggtaaacaaagtctctcagatatcgcctgacatggggatcctgaagtttaaaagctccaag

SEQ ID NO: 23086 - RNA, 1380 nt, synthetic construct
  misc_feature 1..1380: note = derived and/or modified sequence opt3 from Cixutumumab_HeavyChain1
  source 1..1380: mol_type = other RNA
gaggtgcagctggtccaaagcggcgccgaagttaagaaacccgggtcctctgtgaaggtatcatgcaaagctagtggaggtaccttcagctcctacgcaatctcttgggtgagacaggcccctggccaggggctcgagtggatgggaggcattataccaatctttggtacagcgaactatgctcagaagttccaagggagggtcactattacggccgacaaatcgacctcaacagcatacatggaacttagcagtctgcggtccgaggatactgccgtgtattactgtgctcgcgcaccgttgcgatttttagaatggtctacccaggaccactattactattactacatggatgtttggggaaagggcacaaccgtgactgtcagctccgcctcaacaaagggccccagtgtgttccctctggctccaagctctaaatccacctcagggggaacggccgcgctaggttgcctcgtaaaggactattttcccgagcctgttactgtgagctggaatagtggcgcactgacctctggggtccatacattcccagccgtgcttcagtccagcggactgtactcgttgtcttccgtggtcactgttccctcaagtagcctcggcacccagacatatatctgtaacgtgaatcacaaaccttccaacaccaaggtagataaaaaggtggagccaaagtcttgcgacaaaacgcatacttgtccgccctgccctgctccagaactgctgggtgggcccagcgtctttctcttccctccaaagcccaaagatacattaatgatttcacgtaccccggaggtgacttgtgttgtggtcgacgtgagtcacgaagatcctgaggtaaagtttaattggtacgttgacggagtggaggtccataacgccaaaacaaagcccagagaggaacaatataattccacctacagggtggtcagcgtgctgacggttcttcaccaggattggttgaacggcaaagaatataagtgcaaggtgtctaataaagcactgccagctcctatcgagaagaccatatcaaaagccaagggccagccccgggaaccacaggtatacacactaccccctagtcgcgaggagatgactaaaaaccaagtcagcctcacctgtctggtgaaggggttctacccatccgacatcgcggttgaatgggagtctaatggacagccggaaaacaattataagacaactccccctgtgcttgattcggacggtagctttttcctgtactccaaattgaccgtcgacaagtcaagatggcagcaaggcaacgtgtttagttgctctgtaatgcacgaggccctccataatcactatacacagaaaagcctgtccttatcaccagggaag

SEQ ID NO: 23087 - RNA, 642 nt, synthetic construct
  misc_feature 1..642: note = derived and/or modified sequence opt3 from Cixutumumab_LightChain1
  source 1..642: mol_type = other RNA
agctccgagctgacccaggaccccgccgtgtctgtcgctctcggccaaacagttagaatcacttgccagggggattcacttaggagttactatgcaacgtggtaccagcagaagcctggacaagccccaattctggtgatatatggtgaaaacaaacggccgagcggcatccccgaccgcttctccgggtcttcgtcaggaaataccgcgagcttgacaattactggcgctcaggccgaggatgaagcagactactattgtaagagtcgagatggttccgggcagcacttagtatttggaggcggcaccaaactgacagtgctagggcagcctaaggccgctccatctgtcaccctctttccccctagctccgaggaactgcaagcaaacaaagccactcttgtgtgcctgatctcagacttctacccaggagctgttacagtggcctggaaggcggatagtagccccgtcaaggccggtgtggagaccacgactccttctaaacagtccaataacaagtatgcagcttcaagctacttgagtctcaccccagagcagtggaaatctcatcgttcctacagctgtcaggtaacacacgaaggctcgactgttgagaagaccgtggccccggcagaatgctct

SEQ ID NO: 23088 - RNA, 1350 nt, synthetic construct
  misc_feature 1..1350: note = derived and/or modified sequence opt3 from Clazakizumab_HeavyChain1
  source 1..1350: mol_type = other RNA
gaggtgcagctggtcgaaagcggcgggggactcgttcaacccggtggctcccttagactgtcttgcgccgcttcagggttcagtttgagcaactactatgtgacctgggtaaggcaggcacctggaaagggcttagagtgggtgggtatcatttacgggtccgacgaaacagcctatgcgacttctgctataggacggtttacgatctcgcgcgataattcaaagaacaccctgtacctacagatgaatagcctccgagccgaggacacagcagtctattactgtgcccgtgatgacagttccgattgggacgctaaattcaacctgtggggccagggcactcttgtgaccgtttctagcgcatccacaaaagggccatcagtgtttccgctggcccccagtagcaagtctacctccggaggtactgctgccttgggctgcctcgtcaaagattatttccctgaaccagtgacagtatcatggaatagcggggcgctgaccagtggagttcacacgtttcccgcagtgctgcaatcttccggcctctacagcttatcgtctgtcgtgactgtgccttcctcaagtctgggtacccagacatacatttgtaacgtcaatcataagccaagcaacactaaggttgacaaaagagtggagcccaagtcctgcgataaaacccacacatgtcctccatgcccggcccccgagcttttgggagggccttctgtattcctgtttccacccaagcctaaagacaccctaatgatcagcaggacgccagaagtgacttgtgtcgtggttgatgtgtcacatgaggaccccgaagtcaagttcaattggtatgtggatggcgtagaggttcacaacgctaagacaaaaccgcgggaggaacagtacgccagtacctatcgcgtggtctccgtgctcactgtcctgcatcaggactggcttaatggcaaggagtacaaatgcaaggtgagcaacaaagcactgcctgctcccattgaaaagacaatctctaaagccaaggggcaaccaagagagcctcaggtttataccttgcccccatcaagggaagagatgacgaagaatcaggtgagtctcacctgtctggtaaaaggattttaccccagcgacatagcggtcgagtgggaatccaacggtcagcctgagaataactataagacaactccaccggtgttagattctgacggctcgttctttctgtacagcaaactcaccgttgataagtcccggtggcaacaggggaacgtgttctcatgcagtgtcatgcacgaagcccttcacaatcattacacacagaaatctctgagcttgtcccccggaaag

SEQ ID NO: 23089 - RNA, 651 nt, synthetic construct
  misc_feature 1..651: note = derived and/or modified sequence opt3 from Clazakizumab_LightChain1
  source 1..651: mol_type = other RNA
gccatccagatgacccaaagcccctcctctctgtcagctagtgtgggcgacagagtcacaattacttgccaggcaagccagtccataaacaatgagctctcttggtaccagcaaaagcctgggaaagccccaaaacttctgatctatagggcgtcgacgttggcttcaggagttccgagccggttcagtggttccggctctgggaccgattttacattaactattagctccctgcagcccgacgatttcgccacctactattgtcagcagggatactcactacgcaacatcgacaatgcatttggcggtgggacaaaagtggaaattaagcgaaccgtagccgctcctagtgtgttcatctttccacccagcgatgagcaactcaaatctggaactgcatccgtcgtgtgcctgcttaacaatttctatcctcgtgaagccaaggttcagtggaaggtggacaacgctctgcagtcaggcaatagccaggagagtgtcacagaacaagattctaaagactccacctacagcttgtcgtctacgctcactctgtccaaggccgattatgagaaacacaaggtgtacgcgtgtgaggtaacccatcagggcctgtcaagtccagttacaaagagctttaacagaggggaatgc

SEQ ID NO: 23090 - RNA, 1347 nt, synthetic construct
  misc_feature 1..1347: note = derived and/or modified sequence opt3 from Clivatuzumab_tetraxetan_HeavyChain1
  source 1..1347: mol_type = other RNA
caggtgcaactgcagcagagcggcgccgaggtcaagaaacccggggcttccgttaaggtgtcttgcgaagcatcaggatacaccttccctagttatgtactccactgggtgaaacaggccccaggtcaaggccttgagtggatcgggtacattaacccgtataatgacggaacacagtacaacgaaaagtttaaaggcaaggcgactctgacgagagataccagcataaatacagcttatatggagttgtccaggttacggtctgacgatactgccgtctactattgtgcacgcggtttcgggggatcgtacggctttgcctactggggccaggggaccctggtgacagtttcaagcgctagtaccaagggaccctccgtgttccctctagcaccatctagcaaatccacttcaggtggcacagccgctctcgggtgcctggtcaaggactattttcccgaacctgtgaccgtaagttggaacagcggagcccttacgtctggcgttcatactttcccagcggtgctgcagtcctcaggtttgtacagcctcagttctgtcgtgaccgtgccctccagctcgctggggacacaaacttatatctgtaatgtcaaccacaaaccttctaataccaaggttgataaacgagtggagccaaagtcctgcgacaagacacatacctgtccgccctgccctgcaccagagctgctcggaggcccctcagtatttttattccctccaaaacccaaggatacgctgatgattagtcgtactccggaagtgacatgtgtcgtggttgacgtgagccacgaggatcctgaagtcaaatttaactggtacgtggacggcgtagaggttcataatgccaagaccaaacccagagaggaacagtataactccacttacagggtggtctctgtgcttacagtcttgcaccaggattggctgaatgggaaggagtataaatgcaaggtgagcaacaaggctctaccagcccctatcgagaaaaccatttcaaaggcaaaaggacagccccgggaaccacaagtttacacgctgccccctagtcgcgaagagatgaccaagaatcaggtgtccctcacatgtcttgtaaaaggtttctacccaagcgacatcgctgtcgagtgggaatctaacggccagccggagaataactataagactacaccccctgtgctggattcagacgggagctttttcttgtacagcaagctcaccgttgacaaatccagatggcaacagggaaacgtgttttcttgctcggtcatgcacgaagccctgcataatcactatactcagaagagtttatccctgtcaccaggcaaa

SEQ ID NO: 23091 - RNA, 645 nt, synthetic construct
  misc_feature 1..645: note = derived and/or modified sequence opt3 from Clivatuzumab_tetraxetan_LightChain1
  source 1..645: mol_type = other RNA
gacatccagctgacccaaagcccctcctctctctcagccagtgtgggcgatagagtcacaatgacttgcagcgcttcctcttcggtttcaagcagttacctttattggtaccagcagaagcctgggaaagcaccaaagctgtggatttattccacgtctaacttggccagcggagtgccggcgaggttctccggttcaggcagtgggaccgactttacattaactataagctctctgcagcccgaggattccgcttcatacttctgtcaccaatggaatcggtatccttacacctttggaggcggtacacgcctagaaatcaaacgaaccgtagccgcaccaagcgtgttcatttttccccctagtgacgagcagctcaagtctgggactgcctccgtcgtgtgcctgcttaacaatttctatccacgtgaagctaaagttcagtggaaggtggataacgcactgcagagcggaaattcgcaagagtctgtcacagaacaggactccaaggattcaacctacagtttgagctccacgctcactctgtctaaagccgactacgagaagcataaagtgtatgcttgtgaggtaacccaccagggcctgagctcacccgttacaaagagttttaacagaggcgaatgc

SEQ ID NO: 23092 - RNA, 1335 nt, synthetic construct
  misc_feature 1..1335: note = derived and/or modified sequence opt3 from Codrituzumab_HeavyChain1
  source 1..1335: mol_type = other RNA
caggtgcaactggtccagagcggcgccgaggttaagaaacccggggcttccgtgaaggtatcttgcaaagcatcaggatacaccttcacagactatgaaatgcactgggtgagacaggcccctggtcagggcctcgagtggatgggggcgcttgatccaaagactggagacacggcttacagtcaaaaatttaagggcagggtcaccctgacagccgataagagcacttccaccgcatatatggaattgtcttcgttaacatcagaggacaccgccgtgtactattgtactcggttctacagctatacatactggggtcaggggaccctggttacggtgagttccgcttctactaaaggaccgagcgtctttcccctagcaccttcctcaaagagtaccagcggcggcacagccgctctcgggtgcctggtgaaagattacttcccagaacccgtaactgtttcttggaactccggagcccttacctcaggtgtgcatacatttcctgcggtcctgcagagcagtggcttgtattctctctccagcgtggtgaccgtcccatcgtcttccctggggacgcagacttacatctgtaatgttaaccacaagccctcaaatacaaaagtggacaagaaggtagagcctaaaagttgcgataagacccatacttgtccaccgtgccccgcacctgagctgctcggaggcccaagcgtgttcttatttccccctaaaccaaaggacacactgatgatttcccgcacccccgaagtcacgtgtgtggttgtggatgtctctcacgaggacccggaagtgaaattcaactggtatgtagatggtgttgaggtgcataatgccaagaccaaacctcgagaggaacaatacaacagcacatatcgtgtcgtgtcagtccttactgtgttgcaccaggactggctgaatgggaaggagtacaagtgcaaagttagtaacaaggctctacccgccccaatagagaaaaccatctccaaggcaaaaggacagcctagagaaccccaggtgtatacactcccacccagcagggatgaactgactaagaatcaagtatctcttacctgtctggtcaagggcttttacccttcagacattgctgtggagtgggagagtaacggccagccagaaaataactacaaaacaaccccgcccgttttggacagcgatgggtccttctttctctattctaagctgactgtggacaaatcgcggtggcagcaaggaaatgtcttcagctgctccgtgatgcacgaggccttacataaccactacacgcagaagtcactgagtctctctcctggtaaa

SEQ ID NO: 23093 - RNA, 657 nt, synthetic construct
  misc_feature 1..657: note = derived and/or modified sequence opt3 from Codrituzumab_LightChain1
  source 1..657: mol_type = other RNA
gacgtggtcatgacccagagccccctgtccctccctgttacaccaggcgagccggcctctatctcatgcagaagtagccaatcccttgtgcactctaacaggaatacttacctgcattggtatttgcagaagcccgggcagtcgcctcagttactgatttacaaagtatcaaaccggttcagcggagtgccagatcgctttagtggttccggctctgggacggacttcaccctaaagataagccgagtcgaagctgaggatgtgggagtttattactgttcccaaaatacacacgtgccccctacttttggccagggtaccaaactcgaaatcaagcgtacagtcgcagccccatcagtgttcatttttccccctagtgacgagcagctgaaaagcgggaccgcgtctgtagtttgccttctgaacaatttctatccaagagaagctaaggtgcagtggaaggtcgataacgccttgcaatccggaaattcacaggagagcgtgactgagcaggacagtaaagattctacatactccctcagctcgaccctgacgctgtctaaggcagactatgaaaaacataaggtgtacgcctgtgaggtcactcaccagggcctctcctcaccggttaccaaaagttttaacaggggcgaatgc

SEQ ID NO: 23094 - RNA, 1350 nt, synthetic construct
  misc_feature 1..1350: note = derived and/or modified sequence opt3 from Coltuximab_ravtansine_HeavyChain1
  source 1..1350: mol_type = other RNA
caggtgcaactggtccagcccggcgccgaggttgtgaagcctggggctagcgtaaaactctcctgcaagacctctggatacacattcacttcaaactggatgcactgggtgaaacaggcaccaggtcagggccttgaatggatcggggagattgacccgagtgatagctatacgaattacaaccaaaattttcagggaaaggccaaactgaccgtcgacaagtccacatctactgcgtatatggaagtgtcgtcattgagaagcgatgacaccgctgtttactattgtgccaggggcagtaacccctactattacgcaatggattactggggtcaggggacatccgtgaccgtctctagcgcctccactaagggaccttcagtgttcccattagctcccagtagcaaatctacatccggcggcaccgcagccctggggtgcctagtaaaggactattttcctgagccagttacggtgtcatggaatagcggagctctcacaagtggtgtccataccttccccgccgtgctgcagtcttccggcctttacagcctgtcgtctgtggtcacagttccttcctcaagtttggggactcaaacctatatatgtaacgtgaatcacaaaccaagcaacacaaaggtagataaaaaggtggaaccgaagtcctgcgacaaaacccatacgtgtcccccttgcccagcgcccgagctcctgggaggcccttctgtctttctgttcccacccaagccgaaagatactctcatgatcagccggacacctgaggtgacctgtgttgtggtcgacgtgtcacacgaagatcccgaggtaaagtttaattggtacgttgacggtgtggaagtccataacgcaaaaactaagccacgcgaggagcagtataatagtacataccgagtggtctccgtgttaaccgttctgcaccaggattggcttaacgggaaagaatataagtgcaaggtgagcaataaagccttgcctgctcccattgagaagacgatctctaaagccaagggacagccacgtgaaccccaagtatacaccctgcctccatcaagagacgagctaactaaaaaccaggtcagtctcacttgtctggtgaagggcttctacccgagcgacattgcagttgaatgggagtccaatggccagcccgagaacaactataagaccacacctccagtgcttgattctgacgggtcgtttttcctgtacagcaaattgactgtcgataagtccaggtggcaacagggaaatgtgttttcatgcagtgtaatgcacgaagctctccataaccactatacccagaaatctctgagcttatcccccggtaag

SEQ ID NO: 23095 - RNA, 633 nt, synthetic construct
  misc_feature 1..633: note = derived and/or modified sequence opt3 from Coltuximab_ravtansine_LightChain1
  source 1..633: mol_type = other RNA
gagatcgtgctgacccagagccccgccattatgtccgcttctcctggcgaaagagtcacaatgacttgctcagcaagtagcggggttaactacatgcactggtatcaacagaagccaggaacgtccccgaggcggtggatatacgacacctctaaactcgcctcgggtgtgcccgcgcgcttctcaggcagcgggagtggaacagattattcccttactatctctagcatggagcctgaagacgctgccacctactattgtcatcagcgaggctcctacacatttggtgggggaaccaagctggagattaaacgtactgtagcagccccatcagtgttcatctttccccctagtgatgaacagttaaagagcggcacagcttctgtcgtgtgcttgctgaataacttctatccaagagaggcaaaagttcaatggaaggtggacaatgccctacagtccggcaactcacaggagagcgtcaccgaacaggatagtaaggactctacgtactccctcagctcgactctgaccctttctaaagctgattacgagaagcacaaagtgtatgcctgtgaagtaacacatcaagggctgtcctcacccgttactaagagttttaataggggagagtgc

SEQ ID NO: 23096 - RNA, 1356 nt, synthetic construct
  misc_feature 1..1356: note = derived and/or modified sequence opt3 from Conatumumab_CV_HeavyChain
  source 1..1356: mol_type = other RNA
caggtgcaactgcaggagagcggccccgggctcgtcaagccttcccagaccctttctctgacatgcactgtttcaggaggtagtatcagctccggcgactacttctggtcttggattagacagttgccagggaaaggattagaatggataggccacatccataactcgggtacgacctattacaatccgtcactaaagagcagggtgacaattagtgtagatacttccaaaaagcaattttctctgcggctcagctccgtgaccgccgctgacacagcagtctattactgtgcccgcgatcgagggggagactattactatggcatggatgtgtggggccaggggaccactgttacagtgtcaagtgcgagcaccaaaggaccctctgtcttccctctggctccatcctcaaagagcacgagtggtggcactgccgcacttgggtgcctggtgaaggactactttcccgagcctgtaaccgtttcttggaactccggagccttgacaagcggcgtgcacactttcccagctgtcctccagtcgtctggtctgtactccctgtcaagtgtggtgaccgtccccagctcctctctcgggacacagacctatatctgtaatgttaaccataaacctagcaatacgaaggtggataaacgtgtagaaccaaagtcatgcgacaaaactcacacatgtccgccctgccctgcaccagagttactgggaggccccagtgtgtttcttttccctccaaagcccaaggataccttgatgatttccagaactccggaagtcacatgtgtggttgtggacgtcagccatgaggatcctgaggtgaaatttaactggtacgtagacggcgttgaagtgcacaatgccaagaccaaacccagggaggaacaatataactctacgtaccgggtcgtgtcagtcctgaccgtgctacaccaggattggctcaatgggaaggagtataaatgcaaggttagtaacaaagctctgccagcccctatcgagaagacaataagcaaggcgaaaggacagccccgcgaaccacaggtgtacactcttcccccttccagagaggaaatgaccaagaatcaagtatctctgacatgtttggtcaaaggtttctatccatcggacatcgcagtggagtgggaaagcaacggccagccggagaataactacaagactacaccccctgttctcgactccgatgggtcatttttcctgtacagtaaattaaccgtggacaagtctaggtggcagcaaggaaatgtctttagctgctccgtgatgcatgaggccctgcacaaccattatacccagaagtcactcagcctttctccaggcaaa

SEQ ID NO: 23097 - RNA, 645 nt, synthetic construct
  misc_feature 1..645: note = derived and/or modified sequence opt3 from Conatumumab_CV_LightChain
  source 1..645: mol_type = other RNA
gagatcgtgctgacccagagccccggcacactctccctttctcctggggaaagagccactctgtcatgcagggctagtcaaggaattagccggtcctacttggcatggtatcagcagaagccaggtcaggccccgtctttactgatatacggcgcgtcgtcacgcgctacggggatccccgaccgattcagcggaagtggctccggtaccgattttacactaactatttctcgtctcgagcctgaagacttcgccgtctattactgtcaacagtttgggagctccccatggaccttcggacagggcacaaaagttgagatcaagagaaccgtggcagccccctcagtatttattttccctccaagtgatgaacagctgaaaagcggcactgcttctgtggtctgccttctgaacaatttttatcccagggaggcaaaggtgcaatggaaagttgacaacgccttgcagtccggaaattcacaggagagcgtgacagaacaggatagtaaggactctacctactccctcagctcgacgctgactctgtctaaggctgattatgagaaacacaaggtctacgcctgtgaagtgacccatcaagggctctcctcacctgtaacaaaaagtttcaaccggggtgagtgc

SEQ ID NO: 23098 - RNA, 1356 nt, synthetic construct; identical to SEQ ID NO: 23096
  misc_feature 1..1356: note = derived and/or modified sequence opt3 from Conatumumab_HeavyChain1
  source 1..1356: mol_type = other RNA

SEQ ID NO: 23099 - RNA, 1356 nt, synthetic construct; identical to SEQ ID NO: 23096
  misc_feature 1..1356: note = derived and/or modified sequence opt3 from Conatumumab_HeavyChain
  source 1..1356: mol_type = other RNA

SEQ ID NO: 23100 - RNA, 645 nt, synthetic construct; identical to SEQ ID NO: 23097
  misc_feature 1..645: note = derived and/or modified sequence opt3 from Conatumumab_LightChain1
  source 1..645: mol_type = other RNA

SEQ ID NO: 23101 - RNA, 645 nt, synthetic construct; identical to SEQ ID NO: 23097
  misc_feature 1..645: note = derived and/or modified sequence opt3 from Conatumumab_LightChain
  source 1..645: mol_type = other RNA

SEQ ID NO: 23102 - RNA, 1344 nt, synthetic construct
  misc_feature 1..1344: note = derived and/or modified sequence opt3 from Concizumab_HeavyChain1
  source 1..1344: mol_type = other RNA
gaggtgcagctggtcgaaagcggcgggggactcgttaagcccggtggctcccttagactgtcttgcgccgcttcagggttcacctttagtaactacgcaatgagctgggtgaggcaaacacctgagaaacggttggaatgggtagccactatctcccgctctggatcgtattcatacttcccagacagcgtgcagggccgatttacgattagtcgtgataatgcgaagaactccttatatctgcagatgaatagcctaagagctgaggacaccgccgtctactattgtgcaaggctcggtgggtacgatgaaggagacgccatggattcttggggccagggcacaactgtgaccgtttcctcagctagtacaaaagggccgagcgtgttccccctggcaccttgctctcggtccacctcagagagcactgccgctcttggatgtctggtcaaggactattttccagagcccgtgacagtaagttggaactctggtgccttgacctccggcgttcacacgttccctgcggtgctccaaagctcggggctgtactctctgtcctcagtcgtgactgtgccaagtagctccctcggaaccaaaacatacacttgcaatgtcgatcataagccctctaacaccaaggttgacaaacgcgtggaaagcaagtatggccctccatgtccgccctgccctgcaccagagtttttaggtgggccctcagtattcctgtttcctccaaaacccaaggatacacttatgataagtagaaccccggaagtgacgtgtgtcgtggttgacgtgtcccaggaggatcctgaggtccagttcaattggtacgtggacggagtagaagttcacaacgccaaaactaagcccagggaggaacagtttaatagcacatatcgggtggtctctgtgttgaccgtcctgcatcaagattggctaaacggcaaggagtacaaatgcaaggtgtcaaataaaggcctcccaagtagcatcgaaaagactatttccaaagctaaggggcagcctcgcgagccccaggtttatacactgccaccctctcaggaggaaatgaccaaaaaccaagtgtcgcttacgtgtctggtaaagggattctaccctagcgacatcgccgtcgagtgggaatccaatggtcagccagagaacaattataagaccacaccgcccgtgttggactcagatggcagtttctttctctactctcgactgactgttgacaaaagcagatggcaggaagggaacgtgttctcctgctcagtcatgcacgaggcattacataaccactacacccaaaagagcctgtctctctcccttggaaaa

SEQ ID NO: 23103 - RNA, 657 nt, synthetic construct
  misc_feature 1..657: note = derived and/or modified sequence opt3 from Concizumab_LightChain1
  source 1..657: mol_type = other RNA
gacatcgtgatgacccagacacccctgagcctctccgtcactcctggccaaccagcctctatttcatgcaagagtagccagtcccttctggagtctgatgggaaaacgtacttgaactggtatttacagaagccgggacagtcgccccaactgctaatatacctcgtttcaatcctggacagcggtgtgcctgatagattcagtggctccgggtctggaaccgactttacacttaaaattagcagggtagaagctgaggatgtgggcgtctattactgtctgcaggcaactcacttcccacagacctttggtgggggaacaaaggtggaaatcaaacggaccgttgccgcgccctccgtgttcatttttcctccatcagacgagcagttgaagagtggcactgctagcgtcgtgtgcctcctgaataacttctatccccgcgaagccaaggtacaatggaaagttgataatgcactgcagtctggcaactcccaggagtcagtgacagagcaggacagcaaggatagtacctactctctctccagcacgttaactctgtcgaaagccgactatgaaaagcataaagtctacgcttgtgaggtgacccaccaagggctttcttcccctgtgacaaagtcatttaatcgaggagaatgc

SEQ ID NO: 23104 - RNA, 1314 nt, synthetic construct
  misc_feature 1..1314: note = derived and/or modified sequence opt3 from Crenezumab_HeavyChain1
  source 1..1314: mol_type = other RNA
gaggtgcagctggtcgaaagcggcgggggactcgttcaacccggtggctcccttagactgtcttgcgccgcttcagggttcacctttagtagctacggaatgtcctgggtgaggcaggcacctggcaagggtttggagttagtagcctctatcaactcgaatgggggatcaacatattacccagacagcgtgaaaggccggttcactattagtcgcgataacgcgaaaaattccctgtatctacagatgaactctctccgagctgaagacacggccgtctactattgtgcaagcggcgattactgggggcagggaaccacagtgactgtttcctcagccagtaccaaaggtccgagcgtgtttcccctggctccttgctctcgttccacatcagagagcaccgcagcccttggctgtctggtcaaggactatttcccagaacccgtgactgtaagttggaactctggggctttgacatccggagttcacacctttcctgccgtgctccaaagctcgggcctgtactctctgtcctcagtcgtgacggtgccaagtagctccctcggtactaaaacctacacatgcaatgtcgatcataagccctctaatactaaggttgacaaaagagtggagagcaagtatgggcctccatgtccgccctgccctgcgccagagttcttaggaggcccctcagtatttctgttccctccaaaacccaaggatacccttatgataagtaggacaccggaagtgacctgtgtcgtggttgacgtgtcccaggaggatcctgaagtccagtttaactggtacgtggacggcgtagaggttcacaatgcaaaaacgaagccccgggaggaacagttcaacagcacttatcgcgtggtctctgtgttgacagtcctgcatcaagattggctaaatgggaaggagtacaaatgcaaggtgtcaaacaaaggactcccaagtagcatcgaaaagaccatttccaaagccaagggtcagcctagagagccccaggtttatactctgccaccctctcaggaagagatgacaaagaatcaagtgtcgcttacctgtctggtaaagggcttttaccctagcgacatcgctgtcgagtgggaatccaacgggcagccagagaataactataagacgaccccgcccgtgttggattcagacggaagtttctttctctactctaggctgacagttgacaaaagccggtggcaggaaggcaacgtgttctcctgctcagtcatgcacgaggccttacataatcactacactcaaaagagcctgtctctctcccttggt

SEQ ID NO: 23105 - RNA, 657 nt, synthetic construct
  misc_feature 1..657: note = derived and/or modified sequence opt3 from Crenezumab_LightChain1
  source 1..657: mol_type = other RNA
gacatcgtgatgacccagagccccctgtccctccctgtcacaccaggcgagccggcctctatttcatgcagaagtagccaatcccttgtttactctaacggggatacttatctgcactggtacttgcagaaacccggacagtcgcctcagttactgatatataaagtgtcaaataggttcagcggtgtaccagaccggtttagtggctccgggtctggaacggatttcaccctaaagatcagccgcgtggaagctgaggacgtcggcgtgtactattgttcccaatcaacacatgttccctggacttttggtcaggggaccaaagtggaaattaagcgaacagtcgcagcccctagtgtgttcatctttccacccagcgatgagcagctcaaatctggaaccgcgtccgtagtttgcctgcttaacaatttctaccctcgtgaagctaaggtgcagtggaaggtcgacaacgccctgcaatcaggcaatagccaggagagtgtgactgagcaggattctaaagactccacatatagcttgtcgtctaccctcacgctgtccaaggcagattacgaaaaacacaaggtgtacgcctgtgaggtcactcatcagggcctgtcaagtccagttaccaagagctttaacagaggggaatgc

SEQ ID NO: 23106 - RNA, 1365 nt, synthetic construct
  misc_feature 1..1365: note = derived and/or modified sequence opt3 from Crotedumab_HeavyChain1
  source 1..1365: mol_type = other RNA
gaggtgcagctggtcgaaagcggcgggggactcgttcaacccggtggctcccttagactgtcttgcgccgcttcagggttcacctttagtaactacttgatgaattgggtgaggcaggcacctggaaagggcttagagtggctggccaacatccaggaagacggtattgagaaatattacgtagatagcgtgaaggggcggttcacaatatcccgcgacaatgcgaaaaactctctatatctccagatgaactcgctgcgagctgaagatactgccgtctactattgtgcacgtgagccatcacactacgacatccttacgggatatgattactactatggcatggacgtgtggggccaagggaccacagttactgtgagcagtgcctccaccaagggaccgtctgtctttcccctggctccttgcagcagatccacatcagagagtaccgcagccttgggttgtctcgtgaaagattacttcccagaacccgtaactgttagcaataattctggcgctctgacatccggggtgcatacctttcctgccgtcctgcagtcaagcggactctatagtttatcttccgtggtgacggtcccaagctcgtctctgggcactaagacctacacatgcaacgttgaccacaagccctccaatactaaagtggataagagggtagagtcaaaatatggtcctccatgtccgccctgccctgcgccagagttccttgggggacccagtgtgtttttgttccctccaaagcccaaagacaccctgatgattagccggacaccggaggtcacctgtgtggttgtggatgtctcccaggaggaccctgaagtgcagtttaactggtacgtagatggcgttgaggtgcataatgcaaagacgaagccccgcgaagaacaattcaactctacttatagagtcgtgagcgtcctaacagtgctccaccaggactggctgaatggcaaagaatacaagtgcaaagtttcaaacaaggggcttccaagttccatcgagaaaaccattagcaaggccaaaggacagcctagggagccccaggtgtacactctgccaccctctcaagaagagatgacaaagaatcaggtatcattgacctgtctcgtcaagggtttttatcctagtgacatcgctgtggaatgggagagcaacggccagccagaaaacaattacaaaacgaccccgcccgttctggattccgacgggtctttctttttatattcgcggctgacagtggataagagccgctggcaagagggaaacgtcttctcctgctcagtgatgcatgaggccctccacaatcactacactcagaaaagtctttctctgagcttgggcaag

SEQ ID NO: 23107 - RNA, 1365 nt, synthetic construct
  misc_feature 1..1365: note = derived and/or modified sequence opt3 from Crotedumab_HeavyChain2
  source 1..1365: mol_type = other RNA
gaggtgcagctggtcgaaagcggcgggggactcgttcaacccggtggctcccttcacctgtcttgcgccgcttcagggttcacctttagtaactacttgatgaattgggtgagacaggcacctggaaagggcttagagtggctggccaacatccaggaagacggtattgagaaatattacgtagatagcgtgaaggggaggttcacaatatcccgggacaatgcgaaaaactctctatatctccagatgaactcgctgcgcgctgaagatactgccgtctactattgtgcacgagagccatcacattacgacatccttacgggatatgattactactatggcatggacgtgtggggccaagggaccacagttactgtgagcagtgcctccaccaagggaccgtctgtctttcccctggctccttgcagccgttccacatcagagagtaccgcagccttgggttgtctcgtgaaagattacttcccagaacccgtaactgttagcaataattctggcgctctgacatccggggtgcacacctttcctgccgtcctgcagtcaagcggactctatagtttatcttccgtggtgacggtcccaagctcgtctctgggcactaagacctacacatgcaacgttgaccataagccctccaatactgaggtggatgaaagagtagagtcaaaatatggtcctccatgtccgccctgccctgcgccagagttccttgggggacccagtgtgtttttgttccctccaaagcccaaagacaccctgatgattagcaggacaccggaagtcacctgtgtggttgtggatgtctcccaggaggaccctgaagtgcagtttaactggtacgtagatggcgttgaggtgcacaatgcaaagacgaaaccccgggaagaacaattctggtctacttatcgcgtcgtgagcgtcctaacagtgctccatcaggactggctgaacggcaaggagtacaagtgcaaagtttcaaataaggggcttccaagttccatcgagaaaaccattagcaaggccaaaggacagcctagagagccccaggtgtacactctgccaccctctcaagaagagatgacaaagaaccaggtatcattgacctgtctcgtcaaaggtttttatcctagtgacatcgctgtggaatgggagagcaatggccagccagagaacaactacaagacgaccccgcccgttctggattccgacgggtctttctttttatattcgaggctgacagtggatgaaagccggtggcaagagcacaatgtcttctcctgctcagtgatgcacgaagccctccataaccactacactcagaagagtctttctctgagcttgggaaaa

SEQ ID NO: 23108 - RNA, 642 nt, synthetic construct
  misc_feature 1..642: note = derived and/or modified sequence opt3 from Crotedumab_LightChain1
  source 1..642: mol_type = other RNA
gacatccagatgacccaaagcccctcctctctgtcagccagtgtgggcgatagggtcacaattacttgcagggctagccaggggatacggaacgacctcggatggtaccagcagaagcctggtaaagcaccaaagcgccttatctatgccgcgtcctctctgcaatcgggcgttccgtcacgattcagcgggagtggatccggcacggagtttattttgaccgtgtctagcttacagcccgaagatttcgctacatactattgtctgcagtacaatgagaacccttttactttcggtccagggaccaaagtagacatcaagcgtacagtggccgcaccctccgtctttattttccctccatcagatgaacagctaaaaagtggaaccgccagcgtggtttgcctcctgaataacttttatcccagagaggctaaggtgcaatggaaggtcgacaatgcacttcagtctggcaactcccaggaatcagtgactgagcaggatagcaaagacagtacatactctctgtccagcaccttgacgctctcgaaggccgattatgaggaacacaaagtatacgcttgtgaggttactcatcaaggcctgtcttcccctgtgaccaagtcattcaatagaggggaatgc

SEQ ID NO: 23109 - RNA, 642 nt, synthetic construct
  misc_feature 1..642: note = derived and/or modified sequence opt3 from Crotedumab_LightChain2
  source 1..642: mol_type = other RNA
gacatccagatgacccaaagcccctcctctctgtcagccagtgtgggcgatagggtcacaattacttgcagggctagccaggggatacggaacgacctcggatggtaccagcagaagcctggtaaagcaccaaagcgccttatctatgccgcgtcctctctgcaatcgggcgttccgtcacgattcagcgggagtggatccggcacggagtttattttgaccgtgtctagcttacagcccgaagatttcgctacatactattgtctgcagtacaattccaacccttttactttcggtccagggaccaaagtagacatcaagcgtacagtggccgcaccctcagtctttattttccctccaagtgatgagcagctaaaaagcggaaccgcctctgtggtttgcctcctgaataacttttatcccagagaagctaaggtgcaaaataaggtcgacaacgcacttcagtccggcaattcacaggagagcgtgactgaacaggatagtaaagactctacatactccctgagctcgaccttgacgctctctgaggccgattatgagaagcacaaagtatacgcttgtgaagttactcatcaaggcctgtcctcacctgtgaccaagagtttcaacagaggggagtgc

SEQ ID NO: 23110 - RNA, 1332 nt, synthetic construct
  misc_feature 1..1332: note = derived and/or modified sequence opt3 from Dacetuzumab_HeavyChain1
  source 1..1332: mol_type = other RNA
gaggtgcagctggtcgaaagcggcgggggactcgttcaacccggtggctcccttagactgtcttgcgccgcttcagggtacagtttcaccggatattacatccactgggtgaggcaggcacctggcaagggtttggagtgggtagcccgggtgattccaaacgctgggggaacaagctataatcagaaatttaagggccgcttcactttatccgtcgacaactctaaaaatacggcgtacctgcagatgaactcgctacgagccgaagataccgcagtgtattactgtgcccgtgagggcatatattggtgggggcaaggaacactcgttactgtgtcaagcgctagtaccaagggtccgtccgtctttcccctggcaccttctagcaaatccacatcaggcgggaccgccgctcttggatgcctggtgaaggactacttcccagaacccgtaactgttagttggaatagcggcgccttgacatctggtgtgcatacctttcctgcggtcctccagtcctcagggctgtacagcctgagttctgtggtgacggtcccatccagctcgctcggaactcagacctatatctgtaacgttaatcacaagccctctaacacaaaagtggataagaaagtagagcctaagtcctgcgacaaaactcatacctgtccaccgtgccccgcacctgagttactgggcggcccatcagtgttcctttttccccctaagccaaaggatacattgatgattagtagaacccccgaagtcacgtgtgtggttgtggacgtcagccacgaggatccggaagtgaaattcaattggtacgtagacggggttgaggtgcataacgccaagactaaacctagggaggaacagtataattccacataccgggtcgtgtctgtcctgaccgtgctacaccaagattggctcaacggaaaggagtataaatgcaaggttagcaataaagctctgcccgccccaatcgaaaagactatttcaaaggcaaaaggtcagcctcgcgagccccaggtgtacacacttccacccagtagagaagagatgaccaagaaccaggtatccctgacgtgtttggtcaaaggcttttatcctagcgacatcgctgtggagtgggaatctaatgggcaaccagagaacaactacaagaccacaccgcccgttctcgattcagacggaagtttctttctgtacagcaaattaactgtggataagtccaggtggcagcagggcaatgtcttctcttgctcggtgatgcacgaagccctgcataaccactatacccaaaagagcctctccctttcacctggtaaa

SEQ ID NO: 23111 - RNA, 657 nt, synthetic construct
  misc_feature 1..657: note = derived and/or modified sequence opt3 from Dacetuzumab_LightChain1
  source 1..657: mol_type = other RNA
gacatccagatgacccaaagcccctcctctctgtcagccagtgtgggcgatagagtcacaattacttgcaggagctcccagtctctcgttcactcgaacgggaatacgttccttcattggtaccagcagaagcctggaaaagctccaaagctgttgatatataccgtgtcaaaccggtttagcggtgtaccgagtcgcttctccggctctgggagcggaacagactttactttaaccatctcctcactgcaacccgaggatttcgcaacatacttttgtagtcagaccactcacgtgccttggacattcggccagggtaccaaagtcgaaattaagcgaacggtggccgcgccaagcgtttttatctttcccccttctgacgagcagctaaaatccgggactgcttcagtggtctgcctcctgaataacttctatccacgtgaagccaaggtgcaatggaaggtagataatgcacttcagagcggaaacagtcaggagtctgttaccgaacaggactccaaagatagcacatactcgctgtcttccactttgaccctctcaaaggccgactatgagaaacataaggtgtacgcttgtgaggtcacacaccaaggcctgagtagccccgtgaccaaatccttcaatagaggcgaatgc

SEQ ID NO: 23112 - RNA, 318 nt, synthetic construct
  misc_feature 1..318: note = derived and/or modified sequence opt3 from Dacliximab_LightChain_VJ-Region
  source 1..318: mol_type = other RNA
gacatccagatgacccaaagcccctccacactgtctgcctcagtgggcgatagagtcactattacgtgcagtgctagctcctctatatcgtacatgcactggtatcagcagaagcctgggaaagcaccaaagctccttatctacaccacatcaaacctggccagcggagttccggcgaggttcagtggttccggctctgggactgagtttaccttgacaattagctccttacagcccgacgatttcgctacctattactgtcatcaacggtcaacttatcctctgacatttggacagggcaccaaagtggaagtaaag

SEQ ID NO: 23113 - RNA, 348 nt, synthetic construct
  misc_feature 1..348: note = derived and/or modified sequence opt3 from Dacliximab_gamma2-Chain_VDJ-Region
  source 1..348: mol_type = other RNA
caggtgcaactggtccagagcggcgccgaggttaagaaacccgggtcctctgtgaaggtatcatgcaaagctagtggatacaccttcacaagctatagaatgcactgggtgaggcaggcacctggtcagggcctcgaatggatcgggtacattaacccatccactggatatacggagtacaatcaaaagtttaaagacaaggccaccataacagcggatgaatctactaacaccgcttatatggagctttcgtcactgcggagcgaagacacagccgtctactattgtgcacgcggcggtggggtgttcgattactggggacagggcaccttggttactgtgagttcc

SEQ ID NO: 23114 - RNA, 1326 nt, synthetic construct
  misc_feature 1..1326: note = derived and/or modified sequence opt3 from Daclizumab_HeavyChain
  source 1..1326: mol_type = other RNA
caggtgcaactggtccagagcggcgccgaggttaagaaacccgggtcctctgtgaaggtatcatgcaaagctagtggatacaccttcacaagctatagaatgcactgggtgaggcaggcacctggtcagggcctcgaatggatcgggtacattaacccatccactggatatacggagtacaatcaaaagtttaaagacaaggccaccataacagcggatgaatctactaacaccgcttatatggagctttcgtcactgcggagcgaagacacagccgtctactattgtgcacgcggcggtggggtgttcgattactggggacagggcaccactttgacagttagttccggcccgtctgtgtttcccttagcccctagctccaagtcaaccagtgggggaacggctgcactgggttgcctagtcaaagactacttcccagagcccgtgactgtaagctggaactctggcgccctcacctccggggttcatacatttcctgctgtgctgcagtcaagcggactttatagtctgtcttccgtcgtgactgtgccaagctcgtctttgggcacccagacatacatctgtaatgtcaatcacaagccctccaacaccaaagttgataagaaagccgagcctaagtcatgcgacaagacgcatacttgtccaccgtgccccgcgcctgaactcctgggtgggccaagtgtgttcctgtttccccctaaaccaaaggatacactcatgattagccgaacccccgaggtaacttgtgtggtcgtggacgtttcccacgaagatccggaggtgaaattcaattggtatgtcgacggagtggaggtacataacgcaaagacaaaacctcgtgaggaacaatacaattctacctatagagttgtgagcgtcttaacggtgctgcaccaggattggcttaacggcaaggaatacaaatgcaaggtctcaaataaggccttgcccgctccaatcgagaaaaccattagtaaggccaaaggccagcctagggaaccccaggtgtatacactgccaccctcccgggacgagctaactaagaaccaagttagcctcacctgtctggtgaaagggttttacccttctgatatcgcagtagagtgggaatcaaatggacagccagagaacaattacaagacaactccgcccgtccttgacagtgacggtagcttctttctgtattccaagttgaccgtggataaatctcgctggcagcaaggcaacgttttctcgtgcagcgtgatgcacgaagctctccataaccactacacacagaagtccctgtcattaagtcctgggaaa

SEQ ID NO: 23115 - RNA, 630 nt, synthetic construct
  misc_feature 1..630: note = derived and/or modified sequence opt3 from Daclizumab_LightChain
  source 1..630: mol_type = other RNA
gacatccagatgacccaaagcccctccacactgtctgcctcagtgggcgatagagtcactattacgtgcagtgctagctcctctatatcgtacatgcactggtatcagcagaagcctgggaaagcaccaaagctccttatctacaccacatcaaacctggccagcggagttccggcgaggttcagtggttccggctctgggactgagtttaccttgacaattagctccttacagcccgacgatttcgctacctattactgtcatcaacggtcaacttatcctctgacatttggaagtggcaccaaagtggaagtaaagcgcacggtggccgcaccaagcgtcttcatctttcccccttctgacgagcagctaaaatccggtactgcctcagtggtttgcctcctgaataacttctacccacgagaagctaaggtgcagtggaaggtcgataatgcacttcagagcgggaacagtcaagagtctgtgaccgaacaggactccaaagatagcacatattcgctgtcttccactttgaccctctcaaaggccgactacgagaaacacaaggtatacgcttgtgaggttacacatcagggactgagtagccccgtgaccaaatcctttaatcgt

SEQ ID NO: 23116 - RNA, 1341 nt, synthetic construct
  misc_feature 1..1341: note = derived and/or modified sequence opt3 from Dalotuzumab_HeavyChain1
  source 1..1341: mol_type = other RNA
caggtgcaactgcagcagagcggccccgggctcgtcaagccttcccagaccctttctctgacatgcactgtttcaggatggagtatcagcggtggctggttgtggaactggattagacaaccaccggggaaaggattacagtggataggctggatctcctgggacggtacgaataactggaagccctctctgaaagatagggtgaccatttcggtagacacatcaaagaatcagttcagcctaaaactcagttccgtgactgccgctgataccgcagtctggtggtgtgcccggtgggggcgcgtgtttttcgactggtggggacagggcacactggttaccgtgtctagcgcgtccactaagggcccttcagtctttccacttgctcccagtagcaagtctacatccgggggaaccgccgcactgggttgcttggtgaaagattacttccctgagccagtaacggtttcatggaacagcggcgccctcacaagtggggtgcacacctttcccgctgtcctgcaatcttccggactgtatagcctctcgtctgtggtgacagtcccttcctcaagtttaggcactcagacctacatctgtaatgttaaccataagccaagcaatacaaaagtggacaagcgagtagaaccgaaatcctgcgataagacccacacgtgtcccccttgcccagcacccgagctgcttggtgggccttctgtgttcttgtttccacccaagccgaaagacactctgatgattagccgtacacctgaagtcacctgtgtggttgtggatgtctcacatgaggaccccgaagtgaagttcaactggtatgtagatggagttgaggtgcacaatgccaaaactaagccaagagaggaacagtacaacagtacatatagggtcgtgtccgtcctaaccgtgctccatcaggactggctgaatggcaaagagtacaagtgcaaagttagcaacaaggcccttcctgctcccatcgaaaagacgatatctaaagcgaagggccaaccacgggagccccaggtgtataccctgcctccatcacgcgaggaaatgactaaaaatcaggtaagtttgacttgtctcgtcaaggggttttacccgagcgatatcgcagtggagtgggaatccaacggacaacccgagaataactacaaaaccacacctccagttctggactctgacggttcgttctttttatatagcaagctgactgtggataagtccagatggcagcagggcaacgtcttctcatgcagtgtgatgcacgaagccctccacaatcattacacccagaaatctcttagcctgtcccccgggaag

SEQ ID NO: 23117 - RNA, 657 nt, synthetic construct
  misc_feature 1..657: note = derived and/or modified sequence opt3 from Dalotuzumab_LightChain1
  source 1..657: mol_type = other RNA
gacatcgtgatgacccagagccccctgtccctccctgtcacaccaggccaaccggcctctatttcatgcagaagtagccagtccatagttcactctaacgggaatacttggcttcagtggtggctgcagaagcccggacaatcgcctcagttgttaatctggaaagtgtcaaacaggctgtggggtgtaccagatcggttcagcggcagtgggtccggaacggactttaccctaaagatttctcgcgtgcaggctcaggatgtcggcgtgtggtggtgtttccaaggtagccatgttccctggacatttgggcagggaactaaagtgcagatcaagcgaaccgtcgcagccccttccgtgttcatttttccaccctcagacgagcagctcaaaagtggcacagcgagcgtagtttgcctgcttaataacttctaccctcgtgaagctaaggtgcaatggaaggtcgataatgccctgcagtctggcaactcccaggagtcagtgaccgaacaagacagcaaagatagtacttattctttgtccagcacactcaccctgtcgaaggcagactacgagaaacacaaggtgtatgcctgtgaagtcacgcatcaggggctgtcttccccagttactaaatcatttaatagaggagagtgc

SEQ ID NO: 23118 - RNA, 687 nt, synthetic construct
  misc_feature 1..687: note = derived and/or modified sequence opt3 from Dapirolizumab_pegol_HeavyChain1
  source 1..687: mol_type = other RNA
gaggtgcagctggtcgaaagcggcgggggactcgttcaacccggtggctcccttagactgtcttgcgccgtgtcagggttcagtagcaccaactaccacgtacattgggtgaggcaggctcctggaaagggcttggagtggatgggtgtcatctggggagacggggatacatcctataattctgtgttaaaatcgcggtttactatttcacgcgacacgagcaagaacaccgtttacctgcagatgaatagtctacgagcagaagatacagccgtgtattactgtgcgcgtcagctcactcactattacgtcctggctgcctggggccaaggcacccttgtgacagtatcctctgcaagcaccaaagggccatccgttttcccgctggccccctcaagtaagagcacttctggaggtacagctgcattgggctgcctcgtgaaagactattttcctgagccagtcaccgtgtcctggaactcaggggccctgacgagcggagtgcatactttccccgctgtcctgcagagttctggcctctactccttaagctcggttgtgaccgtaccttcttcctcactgggtacacagacttacatatgtaatgtgaaccacaagccaagtaataccaaggtcgataaaaaggtggaacccaaaagctgcgacaagacacatacctgtgccgcg

SEQ ID NO: 23119 - RNA, 642 nt, synthetic construct
  misc_feature 1..642: note = derived and/or modified sequence opt3 from Dapirolizumab_pegol_LightChain1
  source 1..642: mol_type = other RNA
gacatccagatgacccaaagcccctcctctctgtcagccagtgtgggcgatagagtcacaattacttgcagggctagcgaggacctctactataaccttgcatggtaccagcggaagcctgggaaagccccaaagctgttgatatatgatacgtaccgcttagcggacggagttccgtcccgattctctggttcgggctcagggaccgattatacactgactatcagcagtctacagcccgaagactttgcttcctactattgtcagcaatactacaaattcccttttaccttcggacagggcacaaaggtggagattaaacgtaccgtagccgcaccatctgtgtttatctttccccctagcgatgaacagctcaagtccggtactgcctcagtcgtgtgcctgcttaataacttctatccaagagaggctaaggttcagtggaaagtggacaatgcactgcaaagtgggaacagccaggaatctgtcacagagcaggattccaaggactcaacctacagcttgagttctacgctcactctgtccaaagccgattatgagaagcacaaagtgtacgcttgtgaagtaacccatcagggactgagctcgcccgttacaaagtctttcaataggggcgagtgc

SEQ ID NO: 23120 - RNA, 1356 nt, synthetic construct
  misc_feature 1..1356: note = derived and/or modified sequence opt3 from Daratumumab_HeavyChain1
  source 1..1356: mol_type = other RNA
gaggtgcagctgctcgaaagcggcgggggacttgtccaacccggtggctccctgagattgtcttgcgctgtttcagggttcacctttaacagtttcgctatgagctgggtgaggcaggcacctggaaagggcttagagtgggtatccgccatctctggttcagggggaggcacatactatgcggactcggtgaaaggccggtttactattagccgcgataatagtaagaacacgctgtacctacagatgaactccctccgagctgaagacaccgccgtctatttctgtgcaaaagataagatactgtggtttggggagccagtgttcgactactggggacagggtacacttgttactgtgtctagcgcctccaccaaaggcccgtcagtctttcccctggctcctagtagcaagtctacatccgggggaaccgcagccttgggctgcctcgtgaaggattatttcccagaacccgtaactgtttcatggaatagcggtgctctgacaagtggggtgcacacctttcctgccgtcctgcaatcttccggactctacagcttatcgtctgtggtgacggtcccatcctcaagtctgggcactcagacctatatctgtaatgttaaccataaacccagcaatacaaaggtggacaaacgtgtagagcctaagtcctgcgataaaactcacacctgtccaccgtgccccgcgcctgagcttttgggcgggccatctgtgttcctgtttccccctaagccaaaggacacactaatgattagcagaacccccgaagtcacgtgtgtggttgtggatgtctcacatgaggacccggaagtgaaattcaactggtacgtagatggagttgaggtgcacaatgcaaagactaaacctagggaggaacagtacaacagtacatatcgggtcgtgtccgtcctcaccgtgctgcatcaggactggcttaatggtaaggagtacaaatgcaaggttagcaacaaagccctgcccgctccaatcgaaaagactatttctaaggccaaaggccaacctcgcgagccccaggtgtatacattgccaccctcaagagaagagatgaccaagaatcaggtaagtctcacgtgtctggtcaaagggttttaccctagcgatatcgcagtggagtgggaatccaacggacagccagagaataactataagaccacaccgcccgttttagactctgacggctcgttcttcctgtacagcaaactcactgtggataagtccaggtggcaacagggtaacgtcttttcatgcagtgtgatgcacgaagcccttcacaatcattatacccagaagtctctgagcttgtcccctgggaaa

SEQ ID NO: 23121 - RNA, 642 nt, synthetic construct
  misc_feature 1..642: note = derived and/or modified sequence opt3 from Daratumumab_LightChain1
  source 1..642: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccacccacctttggacagggcacaaaagtggagattaagagaaccgtagctgcaccttccgtgttcatctttccaccctcagatgaacagctgaaaagtggtactgccagcgtcgtgtgccttctgaacaatttctatcctagggaggctaaggttcaatggaaagtggacaacgccttgcagtctggaaattcccaggagtcagtcacagaacaggatagcaaggacagtacctactctctctccagcacgctgactctgtcgaaggcggattatgagaaacacaaggtgtacgcatgtgaagtaacccatcaagggctctcttccccagttacaaaatcatttaaccggggcgagtgc

SEQ ID NO: 23122 - RNA, 1350 nt, synthetic construct
  misc_feature 1..1350: note = derived and/or modified sequence opt3 from Dectrekumab_HeavyChain1
  source 1..1350: mol_type = other RNA
gaggtgcagctggtcgaaagcggcgggggagttgtgcaacccggtagatccctcaggctttcttgcgccgcttcaggcttcacctttagtagctacgggatgcactgggtacggcaggcacctggaaagggcctggagtgggtggccatcatttggtatgacggttccaacaaatactatgcggattctgtcaaggggcgcttcacaatatcgcgagacaattcaaagaacactttgtacttacagatgaatagcctgcgtgctgaagatacggccgtgtattactgtgcaagactatggtttggagacctcgatgccttcgacatctggggccagggcaccatggttacagtgagttccgcttctactaaagggccaagcgtctttccgctggcaccctcctcaaaaagtaccagcggaggtacagccgctcttggctgcctggtgaaggattatttccctgagccagtaaccgtttcttggaactccggggccttgacttcaggagtgcatacatttcccgcggtcctccaaagcagtggcctgtactctctgtccagcgtggtgaccgtcccttcgtcttccctcggtacgcagacttacatttgtaatgttaaccacaagccatcaaataccaaagtggacaagagggtagaacccaaaagttgcgataagacacatacttgtcctccatgcccggcacccgagttacttgggggacctagcgtgttcctgtttccacccaaacctaaggacaccttgatgatctcccggacaccagaggtcacctgtgtggttgtggatgtctctcacgaagaccccgaggtgaagttcaactggtatgtagatggcgttgaagtgcataatgccaaaacgaagccgcgcgaggagcagtacaacagcacttatagagtcgtgtcagtcctgacagtgctacaccaggactggctcaatggcaaagaatacaagtgcaaagttagtaacaaggctctgcctgcccccattgagaaaaccatctccaaggcaaaggggcaaccaagggaacctcaggtgtatactcttcccccaagccgggaggaaatgaccaaaaatcaggtatctctgacatgtttggtcaagggattttacccctcagacatagctgtggagtgggagagtaacggtcagcctgaaaataactataaaacgaccccaccggttctcgatagcgacggctccttctttctgtactctaagttaacagtggataaatcgcgctggcaacaggggaacgtcttcagctgctccgtgatgcacgaggccctgcataatcactacactcagaagtcactcagtctttctcccggaaag

SEQ ID NO: 23123 - RNA, 648 nt, synthetic construct
  misc_feature 1..648: note = derived and/or modified sequence opt3 from Dectrekumab_LightChain1
  source 1..648: mol_type = other RNA
gagatcgtgctgacccagagccccgccacactctccctttctcctggcgaaagagctattctgtcatgcagggcagggcaaagtgtcagctcctacttggtttggtatcagcagaagccaggacaggccccgcggttactgatatacgacgcgtctaaccgcgctactggtatccccgcccgattctcgggctcagggagcggaacggattttaccctaacaattagttccctcgagcctgaagacttcgcagtgtattactgtcaacagcgttctagctggccacccgtatatacttttggccagggtaccaaactggagatcaagagaacagtggccgctccttccgtcttcatttttccaccctcagatgaacagcttaaaagtgggaccgcaagcgtggtttgcctgttgaataacttctaccctagggaggccaaggtgcaatggaaagtcgacaatgctctccagtctggaaactcccaggagtcagtgactgaacaggatagcaaggacagtacatattctctgtccagcaccctgacgctctcgaaggccgattacgagaaacacaaggtatacgcgtgtgaagttactcatcaaggcttatcttccccagtgaccaaatcatttaatcggggcgagtgc

SEQ ID NO: 23124 - RNA, 1332 nt, synthetic construct
  misc_feature 1..1332: note = derived and/or modified sequence opt3 from Demcizumab_HeavyChain1
  source 1..1332: mol_type = other RNA
caggtgcagctggtccagagcggcgccgaggttaagaaacccggggcttccgtgaagatctcttgcaaagcatcaggatacagtttcaccgcctattacattcactgggtaaagcaggcgcctggtcagggcctcgaatggatagggtatatcagctcctacaacggagctacaaattataaccaaaaatttaagggcagagtgactttcacgaccgacacatctacttcgaccgcctacatggagcttaggtcactgcggagcgatgacacagcagtctattactgtgcccgcgattacgactatgatgtgggtatggactactgggggcagggaaccttggttactgtgagttccgcttctacaaagggcccaagcgtctttccgttagcaccctgctcccgatcaaccagtgaaagcacggccgctctgggctgtctagtgaaagattatttccctgagccagtaactgtttcttggaatagtggggccctcacctcaggagtgcatacatttcccgcggtcctgcagagcagtggtctttactctctgtccagcgtggtgactgtcccttcgtctaacttcggcacccagacatatacctgcaatgttgaccacaagccatccaacacgaaagtggataagactgtagaacgtaaatgttgcgtggagtgtcccccttgcccagcaccgcccgtcgccgggccttcagtgtttttgttcccacccaagcctaaggacacactcatgattagtagaaccccagaggttacttgtgtggtcgtggatgtaagccatgaagaccccgaggttcaatttaattggtacgtggatggagtcgaagtgcacaacgctaaaacaaagccgagggaggagcagttcaattccacctttcgggtcgtgtctgttctgacggtggtacatcaggactggctgaacggcaaagaatataagtgcaaagtcagcaataagggtctccctgcccccatcgagaaaaccatttcaaagacaaaggggcagccacgcgaacctcaagtgtacactttacccccaagtagagaggaaatgaccaaaaaccaggtttccctgacatgtcttgtgaagggattctaccccagcgacatcgcagtcgagtgggagtctaatggccagcctgaaaacaattataaaactaccccaccgatgttggattcagacggctcctttttcctgtacagcaagctaacagtggataaatccaggtggcaacaggggaacgtattctcttgctcggtgatgcacgaggctctccacaaccattatacccaaaagagcctgtccctttcacccgga

SEQ ID NO: 23125 - RNA, 654 nt, synthetic construct
  misc_feature 1..654: note = derived and/or modified sequence opt3 from Demcizumab_LightChain1
  source 1..654: mol_type = other RNA
gacatcgtgatgacccagagccccgattccctggccgtctctctcggcgagagagctacaatttcatgcagggcaagtgaaagcgttgacaactacgggatatccttcatgaagtggtttcaacagaaacctggacagccaccgaaacttctgatctatgccgcgtctaatcagggttcgggcgtgcccgatcggttctcagggagcggaagtggcactgactttacgttgaccatttcctctttacaagctgaggatgtagccgtgtactattgtcagcagagcaaggaagtcccttggacattcggtgggggaactaaggtggagatcaaacgcaccgttgcagccccatccgtgtttatttttcccccttcagacgaacagctgaagagtggcacagctagcgtcgtgtgcctactcaacaatttctacccacgagaggcaaaggtacaatggaaagttgataacgccctgcagtctggcaattcccaggagtcagtgaccgaacaggacagcaaggatagtacttattctctttccagcacactgaccttgtcgaaagctgactacgagaagcacaaagtctatgcctgtgaagtgacgcatcaagggctctcttcccccgtgactaagtcattcaaccgtggagagtgc

SEQ ID NO: 23126 - RNA, 1350 nt, synthetic construct
  misc_feature 1..1350: note = derived and/or modified sequence opt3 from Denintuzumab_mafodotin_HeavyChain1
  source 1..1350: mol_type = other RNA
caggtgcagctgcaggagagcggccccgggctcgtcaagccttcccagaccctttctctgacatgcactgtttcaggaggtagtatcagcacgtccggcatgggggtgggatggattagacagcacccaggcaaaggtttggaatggatagggcatatctggtgggacgatgacaagaggtacaacccggctttaaaatctcgggtaaccatttcggtggatacatcaaagaatcaattcagcctgaaactaagttccgtcactgctgcagacaccgccgtgtattactgtgcgcgcatggagctctggtcttattactttgattattggggacagggcacactggttaccgtgagctccgcttcaactaagggccccagtgtcttccctcttgccccaagctctaagtccacatcagggggaaccgcagccctgggttgcttggtgaaagactactttcccgaacctgtaacggttagctggaacagtggcgctctcacttctggggtgcacaccttcccagcagtcctgcagtccagcggactgtattcgctctcttccgtggtgacagtcccctcaagtagcttaggcactcagacctacatctgtaatgttaaccataagccttccaatacaaaagtggataagaaagtagagccaaagtcttgcgacaagacccacacgtgtccgccctgccctgccccagaactgcttggtgggcccagcgtgtttttgttccctccaaaacccaaggatactctgatgatttcacgaacaccggaggtcacctgtgtggttgtggacgtcagtcatgaggatcctgaagtgaaatttaactggtacgtagacggagttgaggtgcacaatgctaagactaaaccccgtgaagaacaatataactccacatacagagtcgtgagcgtcctaaccgtgctccaccaggattggctgaatggcaaggagtataaatgcaaggtttctaacaaggcccttccagcgcctatcgagaaaacgatatcaaaggcaaaaggccagcccagggagccacaggtgtacaccctgccccctagtcgggacgaattgacaaagaatcaagtaagcctcacttgtctggtcaaagggttctatccatccgacatcgccgtggagtgggaatctaacggacagccggagaataactacaagaccacaccccctgttttagattcggacggtagctttttcctgtattccaagctcactgtggataaatcacgctggcagcaaggcaatgtctttagttgctctgtgatgcatgaggcccttcacaaccattacacccaaaagagcctgtccttgtcaccagggaaa

SEQ ID NO: 23127 - RNA, 639 nt, synthetic construct
  misc_feature 1..639: note = derived and/or modified sequence opt3 from Denintuzumab_mafodotin_LightChain1
  source 1..639: mol_type = other RNA
gagatcgtgctgacccagagccccgccacactctccctttctcctggcgaaagagctactctgtcatgcagtgcaagctcctctgtctcgtacatgcactggtatcaacagaagccagggcaggccccgaggttgttaatttacgacacgtcaaaactggcgagcggaatacccgctcggttcagtggttccggctctgggaccgattttacactaactatcagctccctcgagcctgaagacgttgccgtgtattactgtttccagggatcagtatatccatttaccttcggccaaggtacaaagctggagattaaacgcaccgtggcagcccccagtgtctttatcttccctccaagcgatgaacagcttaagtctgggactgcttccgtggtttgcctgttgaacaatttttacccccgagaggcaaaagtgcagtggaaggtcgacaacgccctccagtcaggaaatagccaagagagtgtgacagaacaggattctaaggactccacctatagcctgtcgtctacgctgactctctccaaagctgattacgagaagcataaagtatacgcctgtgaagttacccaccagggcttatcaagtcctgtgacaaagagcttcaaccgtggcgagtgc

SEQ ID NO: 23128 - RNA, 1356 nt, synthetic construct
  misc_feature 1..1356: note = derived and/or modified sequence opt3 from Denosumab_HeavyChain
  source 1..1356: mol_type = other RNA
gaggtgcagctgctcgaaagcggcgggggacttgtccaacccggtggctccctgagattgtcttgcgctgcttcagggttcacctttagtagctacgcaatgtcctgggttaggcaggcccctggaaagggcttagagtgggtgtctggtatcacagggtcgggaggctcaacttattacgcggacagcgtaaaaggccggttcacgattagtcgcgataactccaagaataccctgtatctacagatgaactctctccgagctgaagacacagccgtgtactattgtgcaaaagatccagggactaccgtcataatgagctggtttgacccgtggggacagggtacactggtgaccgtttcctcagccagtactaagggccccagcgtgttccctcttgctccatcttccaaatcaacaagcgggggaaccgcagccctgggctgcttggtcaaggattactttcccgagcctgtgacggtaagttggaactctggtgctctcacttccggggttcacaccttcccagccgtgctgcaaagctcgggactgtattctctctcctcagtcgtgacagtgcccagtagctccttaggcactcagacctacatctgtaatgtcaatcataagccttctaacacaaaagttgacaagaaagtggaaccaaagagctgcgataaaacccacacgtgtccgccctgccctgcgccagagctgcttggcgggccctcagtatttttgttccctccaaagcccaaggacactctgatgattagtcgtacaccggaggtgacctgtgtcgtggttgatgtgtcccatgaagaccctgaggtcaaatttaattggtacgtggatggagtagaagttcacaacgcaaagactaaacccagagaggagcagtataatagcacatacagggtggtctctgtgctaaccgtcctccatcaggactggctgaacggtaaggaatataaatgcaaggtgtcaaataaagcccttccagctcctatcgagaagacgattagtaaggccaaaggccaaccccgggaaccacaggtttacaccctgccccctagccgcgatgagttgacaaagaaccaggtgtccctcacttgtctggtaaaagggttctatccatctgacatcgcagtcgaatgggagtcgaatggacagccggagaacaattacaagaccacaccccctgtgttagacagcgatggctcctttttcctgtattcaaaactcactgttgacaagagtagatggcaacagggtaacgtgttttcttgcagcgtcatgcacgaagcccttcacaaccattacacccagaagtccctgtcattgagcccagggaaa

SEQ ID NO: 23129 - RNA, 645 nt, synthetic construct
  misc_feature 1..645: note = derived and/or modified sequence opt3 from Denosumab_LightChain
  source 1..645: mol_type = other RNA
gagatcgtgctgacccagagccccggcacactctccctttctcctggggaaagagccactctgtcatgcagggctagtcaaagcgtccggggacgctacttggcatggtatcagcagaagccaggtcaggccccgcgattactgatttacggcgcgtcctctcgtgctacggggatacccgacagattctcgggatcaggcagcggtaccgattttacactaactatcagtaggctcgagcctgaagacttcgccgtgttttattgtcaacagtacgggtcctctccacggaccttcggacagggcacaaaagttgagattaagcgcaccgtagcagcccccagcgtgtttatcttccctccatccgatgaacagctgaaatcaggcactgctagtgtcgtgtgccttctgaacaatttttatcccagagaggcaaaggttcaatggaaagtggacaacgccttgcagagcggaaattctcaggagtccgtcacagaacaggattcaaaggacagcacctacagtctctcttccacgctgactctgagcaaggctgattatgagaaacacaaggtgtacgcctgtgaagtaacccatcaagggctctcgtctcctgttacaaaatccttcaacaggggtgagtgc

SEQ ID NO: 23130 - RNA, 1338 nt, synthetic construct
  misc_feature 1..1338: note = derived and/or modified sequence opt3 from Depatuxizumab_HeavyChain1
  source 1..1338: mol_type = other RNA
caggtgcaactgcaggagagcggccccgggctcgtcaagccttcccagaccctttctctgacatgcactgtttcaggatacagtatcagctccgacttcgcctggaactggattagacagccaccgggtaaaggcttggaatggatggggtatatatcttactcgggaaatacgaggtatcaaccctcattaaagagccggatcaccattagtcgcgatacatccaaaaaccagtttttcctgaagctaaattctgtgactgctgcagacaccgccacatactattgtgtaaccgcgggccgaggttttccttactgggggcagggaactctcgtgacagtcagctccgcttcaaccaaaggcccaagtgtgttccccctggcccctagctctaagtccacgtcaggcgggactgcagcccttggatgcctggttaaggattattttccagagcccgtgaccgtcagctggaacagtggtgctttgacatctggcgtgcacactttccctgcagtactccagtccagcgggctgtactcgctgtcttccgttgtgaccgtcccatcaagtagcctcggaacacaaacctacatctgtaatgtgaaccataaaccgtccaatacgaaggtggacaaaaaggtcgaacccaaatcttgcgataagactcacacatgtcctccatgccccgcccctgagttactgggcggtccaagcgtttttctttttcccccgaagcctaaagacaccttgatgatttcacgtactcccgaagtgacatgtgtagtggtcgatgtgagtcatgaggacccagaggttaagttcaactggtatgtggatggggtcgaagtgcacaatgctaaaaccaagcctagagaggaacagtacaactccacgtatagggtagttagcgtgctgaccgtcctacatcaggactggctcaatggaaaagagtacaagtgcaaagtgtctaacaaggccctgcccgcgccaatcgagaagacaatatcaaaagcaaagggccagccccgggaacctcaagtctatactcttccaccgagtcgcgatgagctgaccaaaaatcaggtgagcttgacatgtctcgttaagggcttctacccctccgacatcgccgtggaatgggagtctaacgggcagcctgaaaataactataaaactaccccacccgtactggattcggacggtagctttttcttatactccaagctgacagtcgacaagtcaagatggcaacagggaaacgtgtttagttgctctgttatgcacgaggctctccacaatcattacacccagaaaagcctttccctgtcacctggcaag

SEQ ID NO: 23131 - RNA, 642 nt, synthetic construct
  misc_feature 1..642: note = derived and/or modified sequence opt3 from Depatuxizumab_LightChain1
  source 1..642: mol_type = other RNA
gacatccagatgacccaaagcccctcctctatgtcagtgagtgtcggcgatagagttacaattacttgccacagctcccaggacataaactctaatatcgggtggctgcagcagaagcctggaaaatcgttcaagggtctcatttaccatggcacgaaccttgatgacggggtgccatcaaggtttagcggaagtggctccggtaccgattatacactgactatctctagcttgcaaccggaggacttcgccacctactattgtgtacagtacgctcagtttccctggacattcgggggaggcaccaaattagaaattaagcggactgtggcagccccttccgtctttatcttcccaccctcagatgagcagctgaaaagtggcacagcgagcgtggtttgcctactcaataacttttatcctcgcgaagctaaggtgcaatggaaggtcgacaatgccctgcagtctgggaactcccaggagtcagtgaccgaacaggatagcaaagacagtacgtactctctttccagcactctgaccttgtcgaaggcagattatgagaaacacaaggtatacgcctgtgaggttacacatcaaggactctcttccccagtgactaaatcattcaatcgaggtgaatgc

SEQ ID NO: 23132 - RNA, 1338 nt, synthetic construct; identical to SEQ ID NO: 23130
  misc_feature 1..1338: note = derived and/or modified sequence opt3 from Depatuxizumab_mafodotin_HeavyChain1
  source 1..1338: mol_type = other RNA

SEQ ID NO: 23133 - RNA, 642 nt, synthetic construct; identical to SEQ ID NO: 23131
  misc_feature 1..642: note = derived and/or modified sequence opt3 from Depatuxizumab_mafodotin_LightChain1
  source 1..642: mol_type = other RNA

SEQ ID NO: 23134 - RNA, 1329 nt, synthetic construct
  misc_feature 1..1329: note = derived and/or modified sequence opt3 from Dinutuximab_beta_HeavyChain1
  source 1..1329: mol_type = other RNA
gaggtgcagctgctccaaagcggccccgaacttgagaagcctggggcctccgtcatgatctcttgcaaggcttcaggaagtagcttcaccggttacaacatgaattgggttagacagaacattggcaaatccctggaatggataggggcaatcgacccatattacggaggcacatcttataatcagaaatttaagggtagggccactttgacggtggataaatcgtcaagcaccgcgtacatgcacttaaagagtctgacatccgaggactctgctgtatattactgtgtgagcgggatggaatattggggacagggcacttccgtcaccgtgtcaagtgccagcacaaagggcccgtctgttttccccctagcaccttcctcaaaaagcaccagtgggggaactgccgctctcggttgcctggtgaaggattactttccagagcccgtcacagtgtcttggaactccggcgcacttaccagcggggtacatacgttccctgccgttctgcaatcgtctggattgtactccctctcaagtgtggtcactgtgccaagctcctctctgggcacccagacatatatttgtaatgtgaaccacaaacccagcaatactaaggtcgacaaacgggttgagcctaagtcatgcgataagacccatacatgtccaccgtgccccgctcctgaactgctcggtgggccaagtgtgtttttatttccccctaaaccaaaggacaccctgatgatctcccgcacgcccgaggtaacttgtgtggtcgtggatgttagccacgaagacccggaggtgaaattcaactggtacgtcgatggagtggaggtacataatgccaagacaaaacctcgagaggaacagtataactctacctaccgtgttgtgtcagtccttactgtgttgcaccaggactggctgaatggcaaggaatataaatgcaaggtcagtaacaaggcgctacccgcaccaattgagaaaacaatcagcaaggccaaaggccaacctagagaaccccaggtgtacaccctcccaccctccagggaggagatgacgaagaatcaggtttctctgacctgtcttgtgaaagggttctatccttcggatatagctgtagaatgggagagcaacggacagccagaaaataactacaagacaactccgcccgtcctggactccgatggttcatttttcttgtacagtaagctcaccgtggacaaatctcggtggcaacagggcaacgtttttagctgctccgtgatgcacgaggccctgcataatcactatacacagaagtcattaagcctgtctcctgggaaa

SEQ ID NO: 23135 - RNA, 660 nt, synthetic construct
  misc_feature 1..660: note = derived and/or modified sequence opt3 from Dinutuximab_beta_LightChain1
  source 1..660: mol_type = other RNA
gagatcgtgatgacccagagccccgccacactgtccgtctctcctggcgaacgggctactctctcatgcaggagtagccaatcccttgttcaccggaacgggaatacgtacctgcattggtatttgcagaagccaggacagtctccgaaattactgattcacaaggtgtcgaaccgcttctcaggtgtacccgaccgatttagcggcagtgggtccggaaccgatttcacactaaaaatatctcgtgtggaggcagaagacctcggcgtctacttttgtagccagtccactcatgtgcctccactgaccttcggtgccgggacaaagttggagctgaaaagaaccgttgcggctccctcagtgtttatcttccctccaagtgatgaacaacttaagagcggaactgcctctgtcgtgtgcctcctgaataacttttatcccagggaggcaaaggtacagtggaaagttgacaatgccctgcagtccggcaactcacaggagagcgtgacagaacaagatagtaaggactctacctactccctcagctcgacgttaactctgtctaaagctgattatgagaagcacaaagtctacgcatgtgaagtgacccatcagggcctttcctcacctgtgacaaagagtttcaatagaggggagtgc

SEQ ID NO: 23136 - RNA, 1329 nt, synthetic construct; identical to SEQ ID NO: 23134
  misc_feature 1..1329: note = derived and/or modified sequence opt3 from Dinutuximab_HeavyChain1
  source 1..1329: mol_type = other RNA

SEQ ID NO: 23137 - RNA, 660 nt, synthetic construct; identical to SEQ ID NO: 23135
  misc_feature 1..660: note = derived and/or modified sequence opt3 from Dinutuximab_LightChain1
  source 1..660: mol_type = other RNA

SEQ ID NO: 23138 - RNA, 660 nt, synthetic construct; identical to SEQ ID NO: 23135
  misc_feature 1..660: note = derived and/or modified sequence opt3 from Dinutuximab_LightChain
  source 1..660: mol_type = other RNA

SEQ ID NO: 23139 - RNA, 1350 nt, synthetic construct
  misc_feature 1..1350: note = derived and/or modified sequence opt3 from Diridavumab_HeavyChain1
  source 1..1350: mol_type = other RNA
gaggtgcagctggtcgaaagcggcgccgaggttaagaaacccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtgcttccactaaaggaccatctgtattccccctggcacctagctccaagtcaacaagtggtggcaccgccgctttggggtgcttagttaaagactactttccagagcccgtgacggtcagctggaactctggagccctgacttccggcgtgcataccttccctgcggtgctacaatcaagcggtctctatagtctgtcttccgtcgttacagtgccaagctcgtctcttgggactcagacctacatctgtaatgtaaaccacaagccgtccaatacaaaagtggataagcgtgtcgaacccaagtcatgcgacaaaacccatacgtgtcctccatgccccgcacctgagctgttgggaggcccaagtgtgtttctctttcccccgaagcctaaagatactctgatgattagcagaacacccgaagttacctgtgtggtcgtggacgtatcccacgaggatccagaggttaagttcaactggtacgtggacggcgtcgaagtgcataatgccaaaactaagcctagggaggaacagtataactctacataccgggtcgtgagcgttctgaccgtgctccaccaggattggttaaatgggaaagagtataagtgcaaggtatcaaacaaagctctgcccgccccaatcgaaaagacgataagtaaagcaaagggacaaccccgcgagcctcaggtctacacccttccaccgtccagagaggaaatgactaaaaatcaggtgagcttgacatgtctggttaagggtttctatccctctgacatcgctgtggagtgggaatcaaacggccagcctgagaataactacaagaccacaccacccgtcctagatagtgacgggagctttttcctctattccaaactgactgtggacaagtctaggtggcaacagggaaatgtattttcgtgcagcgtgatgcacgaagcccttcataaccactacacccagaaatccctgtcattgagtcctggc

SEQ ID NO: 23140 - RNA, 651 nt, synthetic construct
  misc_feature 1..651: note = derived and/or modified sequence opt3 from Diridavumab_LightChain1
  source 1..651: mol_type = other RNA
cagagcgtgctgacccaacccccttccgtctctgccgctccaggccagaaggttacaatctcatgcagtgggagctcctctaacattggaaatgactacgtgtcgtggtatcagcagctcccgggtactgcacccaaacttctgatatacgataacaataagagaccttcaggcatcccagacaggttcagcgggagtaaatccggaacgtctgccaccttgggcattacaggtttacaaactggggatgaggcgaactattactgtgctacctgggaccggcgccccacagcctatgtagtgtttggaggcggcaccaagctgactgtcctagggcagcctaaagcagccccaagcgtgacactctttcccccttcctcagaggaactgcaggctaataaggcaacccttgtttgcctgatcagtgatttctacccaggagccgtgacggtcgcttggaaggccgacagctctccggtgaaagcgggtgtagaaactaccacaccctccaagcagtcaaacaataaatatgcagccagcagttacttgtctctcactcctgagcaatggaagtcccaccgaagctactcgtgtcaggttacccatgaaggctctacagtggagaaaaccgtcgctccaacggagtgctcc

SEQ ID NO: 23141 - RNA, 1338 nt, synthetic construct
  misc_feature 1..1338: note = derived and/or modified sequence opt3 from Domagrozumab_HeavyChain1
  source 1..1338: mol_type = other RNA
gaggtgcagctgctcgaaagcggcgggggacttgtccaacccggtggctccctgagattgtcttgcgccgcttcagggttcacctttagtagctacgcaatgtcctgggttaggcaggcccctggaaagggcttagagtgggtgtctacaatctcgtcaggtgggagctatacgagttacccagactccgtaaaaggacggttcactatttctcgcgataacagcaagaataccctgtatctacagatgaactccctccgagcggaagacacagctgtgtactattgtgccaaacaggattacgcaatgaattattggggccaaggcactctggtcaccgtgtcaagtgccagcacaaaggggccgtctgtttttccccttgctccttcctcaaaaagcaccagtggaggtactgcagccctgggctgcttggtgaaggactacttcccagagcccgtcacagtgtcttggaactccggggctctcaccagcggagtacacacgtttcctgccgttctgcagtcgtctggcctgtactccctctcaagtgtggtcactgtgccaagctcctctttaggtacccagacatatatatgtaatgtgaaccataagcccagcaatactaaagtcgataagaaagttgaacctaagtcatgcgacaaaacccacacatgtccaccgtgccccgcgcctgaggcagccggggctccaagtgtgttcctgtttccccctaagccaaaggatacccttatgatctcccgtacgcccgaggtaacttgtgtggtcgtggacgttagccatgaagatccggaggtgaaattcaactggtacgtcgacggagtggaagtacacaatgccaagacaaaacctagagaggagcagtataactctacctacagggttgtgtcagtcttgactgtgctgcatcaagattggctaaatggcaaggaatataaatgcaaggtcagtaacaaagcactccccgctccaattgagaagacaatcagcaaggccaaaggccagcctcgggaaccccaggtgtacaccctgccaccctcccgcgaggaaatgacgaagaatcaggtttctcttacctgtctggtgaaagggttttatccttcggacattgcggtagagtgggagagcaacggacaaccagaaaataactacaagacaactccgcccgtcttggattccgacggttcattctttctctacagtaaactgaccgtggacaagtctagatggcagcagggcaacgttttcagctgctccgtgatgcacgaggccttacacaatcattatacacaaaagtcactgagcctctctcctgggaaa

SEQ ID NO: 23142 - RNA, 1335 nt, synthetic construct
  misc_feature 1..1335: note = derived and/or modified sequence opt3 from Domagrozumab_HeavyChain
  source 1..1335: mol_type = other RNA
gaggtgcagctgctcgaaagcggcgggggacttgtccaacccggtggctccctgagattgtcttgcgccgcttcagggttcacctttagtagctacgcaatgtcctgggttaggcaggcccctggaaagggcttagagtgggtgtctacaatctcgtcaggtgggagctatacgagttacccagactccgtaaaaggacggttcactatttctcgcgataacagcaagaataccctgtatctacagatgaactccctccgagcggaagacacagctgtgtactattgtgccaaacaggattacgcaatgaattattggggccaaggcactctggtcaccgtgtcaagtgccagcacaaaggggccgtctgtttttccccttgctccttcctcaaaaagcaccagtggaggtactgcagccctgggctgcttggtgaaggactacttcccagagcccgtcacagtgtcttggaactccggggctctcaccagcggagtacacacgtttcctgccgttctgcagtcgtctggcctgtactccctctcaagtgtggtcactgtgccaagctcctctttaggtacccagacatatatatgtaatgtgaaccataagcccagcaatactaaagtcgataagaaagttgaacctaagtcatgcgacaaaacccacacatgtccaccgtgccccgcgcctgaggcagccggggctccaagtgtgttcctgtttccccctaagccaaaggatacccttatgatctcccgtacgcccgaggtaacttgtgtggtcgtggacgttagccatgaagatccggaggtgaaattcaactggtacgtcgacggagtggaagtacacaatgccaagacaaaacctagagaggagcagtataactctacctacagggttgtgtcagtcttgactgtgctgcatcaagattggctaaatggcaaggaatataaatgcaaggtcagtaacaaagcactccccgctccaattgagaagacaatcagcaaggccaaaggccagcctcgggaaccccaggtgtacaccctgccaccctcccgcgaggaaatgacgaagaatcaggtttctcttacctgtctggtgaaagggttttatccttcggacattgcggtagagtgggagagcaacggacaaccagaaaataactacaagacaactccgcccgtcttggattccgacggttcattctttctctacagtaaactgaccgtggacaagtctagatggcagcagggcaacgttttcagctgctccgtgatgcacgaggccttacacaatcattatacacaaaagtcactgagcctctctcctggg

SEQ ID NO: 23143 - RNA, 642 nt, synthetic construct
  misc_feature 1..642: note = derived and/or modified sequence opt3 from Domagrozumab_LightChain1
  source 1..642: mol_type = other RNA
gacatccagatgacccaaagcccctcctctctgtcagccagtgtgggcgatagagtcacaattacttgcaaggctagccaggacgtttccacggcagtggcctggtaccagcagaaacctgggaaggcgccaaaactccttatatattctgcttcgtacaggtataccggagtaccgtcacggttcagcggtagtggctccgggacagattttactctgaccatctctagcttgcaacccgaggacttcgccacatactattgtcagcagcactactccaccccttggacttttggaggcggtacaaaggtggaaattaaacgcaccgtcgcagccccatcagtgttcatctttccccctagtgatgagcagttaaagagcgggacggcttctgttgtgtgcctgctaaacaatttctatccacgagaagcaaaggtccaatggaaagtggacaacgccctccagtccggaaattcacaggagagcgtaactgaacaggatagtaaggactctacctactccctgagctcgacacttactctgtctaaagctgattacgagaagcataaagtttatgcctgtgaggtgacccaccaaggcttgtcctcacccgtcacaaagagttttaaccgtggcgaatgc

SEQ ID NO: 23144 - RNA, 1335 nt, synthetic construct
  misc_feature 1..1335: note = derived and/or modified sequence opt3 from Drozituab_HeavyChain1
  source 1..1335: mol_type = other RNA
gaggtgcagctggtccaaagcggcgggggagttgaaagacccggtggctccctcaggctttcttgcgccgcttcagggttcacctttgacgattacgcaagttgggtgcggcaggcccctggaaagggcctggagtgggtaagcggtatcaactggcaagggggatccacaggctatgcggactctgtgaaaggccgcgtcactatttcgcgagataatgctaagaactcattgtacttacagaatagcctgcgtgccgaagacacggcagtgtattactgtgccaaaatactaggggctggaagaggttggtatttcgattactggggcaaggggaccacagttactgtgagttccgcatctaccaaaggaccaagcgtctttccgctcgccccctcctcaaagagtacaagcggcggtaccgctgccctggggtgccttgtgaaggactatttccctgagccagtaactgtttcttggaactccggagcgctgacatcaggcgtgcacacctttcccgcagtcttgcagagcagtggcctctactctctgtccagcgtggtgacggtcccttcgtcttccctggggactcagacctacatctgtaatgttaaccataaaccatcaaatacaaaggtggataaaaaggtagaacccaaaagttgcgacaagactcacacctgtcctccatgcccggcccccgagctcttaggaggtcctagcgtgttcctgtttccacccaagcctaaagatacacttatttccaggaccccagaggtcacgtgtgtggttgtggacgtctctcatgaagatcccgaggtgaagttcaactggtatgtagacggcgttgaagtgcacaatgctaaaactaagccgcgggaggagcagtacaacagcacatatcgcgtcgtgtcagtcttgaccgtgctgcatcaggattggctaaatgggaaagaatacaagtgcaaagttagtaacaaggccctccctgcacccatcgagaagactatttccaaagctaagggacaaccaagagaacctcaggtgtatacactgcccccaagcagggaggaaaccaaaaatcaggtatctcttacgtgtctggtcaagggcttttacccctcagacatcgccgtggagtgggagagtaacggtcagcctgaaaataactataaaaccacaccaccggttttggacagcgatgggtccttctttctctactctaagctgactgtggacaagtcgcggtggcaacagggcaacgtcttcagctgctccgtgcacgaggcgttacacaatcattacacccagaaatcactgagtctctctcccgga

SEQ ID NO: 23145 - RNA, 639 nt, synthetic construct
  misc_feature 1..639: note = derived and/or modified sequence opt3 from Drozituab_LightChain1
  source 1..639: mol_type = other RNA
agcgagctgacccaggaccccgccgtgtccgtcgctctcggccaaacagttagaatcacttgctctggggattcacttaggagttactatgcaagctggtaccagcagaagcctggacaggccccagtgctggtaatttatggtgcgaacaatcggccgtccggcatacccgaccgcttctctgggtcgtcaagcggaaacacggctagtttgaccatcacaggcgcccaagcagaagatgaggccgactactattgtaattccgctgattctagcggtaaccacgtggtctttgggggaggcactaaattaaccgtgctgggccagcctaaggcagccccatccgttacactatttcccccttcaagtgaagaactccaggctaataaagccaccctggtgtgccttattagcgacttctacccaggggcggtcactgtggcatggaaggccgattcttcccccgtaaaagctggagttgaaacaaccacgccttcaaagcagagcaacaataagtatgccgcaagttcttacctgtccttgactccagagcaatggaaaagccataagtcgtactcttgtcaggtgacccacgagggttccacagtcgagaaaactgtggctccgaccgagtgctca

SEQ ID NO: 23146 - RNA, 1353 nt, synthetic construct
  misc_feature 1..1353: note = derived and/or modified sequence opt3 from Drozitumab_HeavyChain1
  source 1..1353: mol_type = other RNA
gaggtgcagctggtccaaagcggcgggggagttgaaagacccggtggctccctcaggctttcttgcgccgcttcagggttcacctttgacgattacgcaatgagttgggtgcggcaggcccctggaaagggcctggagtgggtaagcggtatcaactggcaagggggatccacaggctatgcggactctgtgaaaggccgcgtcactatttcgcgagataatgctaagaactcattgtacttacagatgaatagcctgcgtgccgaagacacggcagtgtattactgtgccaaaatactaggggctggaagaggttggtatttcgattactggggcaaggggaccacagttactgtgagttccgcatctaccaaaggaccaagcgtctttccgctcgccccctcctcaaagagtacaagcggcggtaccgctgccctggggtgccttgtgaaggactatttccctgagccagtaactgtttcttggaactccggagcgctgacatcaggcgtgcacacctttcccgcagtcttgcagagcagtggcctctactctctgtccagcgtggtgacggtcccttcgtcttccctggggactcagacctacatctgtaatgttaaccataaaccatcaaatacaaaggtggataaaaaggtagaacccaaaagttgcgacaagactcacacctgtcctccatgcccggcccccgagctcttaggaggtcctagcgtgttcctgtttccacccaagcctaaagatacacttatgatttccaggaccccagaggtcacgtgtgtggttgtggacgtctctcatgaagatcccgaggtgaagttcaactggtatgtagacggcgttgaagtgcacaatgctaaaactaagccgcgggaggagcagtacaacagcacatatcgcgtcgtgtcagtcttgaccgtgctgcatcaggattggctaaatgggaaagaatacaagtgcaaagttagtaacaaggccctccctgcacccatcgagaagactatttccaaagctaagggacaaccaagagaacctcaggtgtatacactgcccccaagcagggaggaaatgaccaaaaatcaggtatctcttacgtgtctggtcaagggcttttacccctcagacatcgccgtggagtgggagagtaacggtcagcctgaaaataactataaaaccacaccaccggttttggacagcgatgggtccttctttctctactctaagctgactgtggacaagtcgcggtggcaacagggcaacgtcttcagctgctccgtgatgcacgaggcgttacacaatcattacacccagaaatcactgagtctctctcccggaaag

SEQ ID NO: 23147 - RNA, 639 nt, synthetic construct; identical to SEQ ID NO: 23145
  misc_feature 1..639: note = derived and/or modified sequence opt3 from Drozitumab_LightChain1
  source 1..639: mol_type = other RNA

SEQ ID NO: 23148 - RNA, 1353 nt, synthetic construct
  misc_feature 1..1353: note = derived and/or modified sequence opt3 from Duligotumab_HeavyChain1
  source 1..1353: mol_type = other RNA
gaggtgcagctggtcgaaagcggcgggggactcgttcaacccggtggctcccttagactgtcttgcgccgcttcagggttcaccttgagtggagactggatccactgggtgaggcaggcacctggcaagggtttagagtgggtaggggaaattagcgccgcgggaggctacacagattatgctgactccgtgaaaggccggtttactatatctgccgatacgtcgaagaacaccgcatacctgcagatgaatagcctacgcgccgaggacacagctgtctattactgtgcacgagaaagccgtgtgagtttcgaggccgctatggattattgggggcagggaactctcgttaccgtgtcctctgccagcacaaaaggtccatccgtctttccgctggcgccctcaagtaagagcacctctggcgggactgcagcccttggatgcctggtgaaagactacttccctgagccagtaacagtttcctggaactcaggcgctttgaccagcggtgtgcatacgtttcccgccgtcctccaaagttctgggctgtattccctgagctcggtggtgactgtcccttcttcctcactcggaacccagacatacatctgtaatgttaaccacaagccaagtaatactaaggtggataaaaaggtagaacccaaaagctgcgacaagacccatacatgtcctccatgcccggcacccgagttactgggcggcccttccgtgttcctttttccacccaaacctaaggataccttgatgatttctagaacgccagaagtcacttgtgtggttgtggacgtcagccacgaggatcccgaggtgaagttcaactggtacgtagacggggttgaagtgcataatgctaaaacaaagccgagggaggaacagtataactcaacctaccgggtcgtgagtgtcctgactgtgctacaccaggattggctcaatggaaaagagtataagtgcaaagtttccaacaaggccctgcctgcgcccatcgagaaaacaattagcaaggccaagggtcaaccacgcgaacctcaggtgtacacccttcccccatctagagaggaaatgacgaaaaatcaggtatcactgacctgtttggtcaagggcttttatcccagtgacatcgcagtggagtgggaaagcaacgggcagcctgagaataactacaaaacaactccaccggttctcgactccgatggatctttctttctgtattcgaagttaaccgtggacaaatcaaggtggcaacagggcaatgtcttctcctgctcagtgatgcacgaagctctgcataaccactacacacagaagagtctctctcttagccccggtaag

SEQ ID NO: 23149 - RNA, 642 nt, synthetic construct
  misc_feature 1..642: note = derived and/or modified sequence opt3 from Duligotumab_LightChain1
  source 1..642: mol_type = other RNA
gacatccagatgacccaaagcccctcctctctgtcagccagtgtgggcgatagagtcacaattacttgcagggctagccagaacatagcaacggacgttgcctggtaccagcagaagcctgggaaagcgccaaagctccttatctattccgcttctttcctgtactcgggagtgccgtcacggtttagcggtagtggctccgggaccgatttcacattgactatttctagcttacaacccgaggactttgccacctattactgtcagcagtccgaacctgagccatatacattcggacagggcaccaaagtagaaatcaagcgcactgtggcagccccctcagtctttattttccctccaagtgatgagcaactgaaaagcggtacagcttctgtggtttgcctactcaataacttttacccccgagaagcaaaggtgcagtggaaggtcgacaatgccctgcagtccgggaactcacaggagagcgtgaccgagcaagatagtaaagactctacgtattcccttagctcgactctgaccttgtctaaggctgattacgaaaaacacaaggtatacgcctgtgaggttacacatcagggactctcctcacctgtgactaaaagtttcaatcgtggcgaatgc

SEQ ID NO: 23150 - RNA, 1353 nt, synthetic construct; identical to SEQ ID NO: 23148
  misc_feature 1..1353: note = derived and/or modified sequence opt3 from Duligotuzumab_HeavyChain1
  source 1..1353: mol_type = other RNA

SEQ ID NO: 23151 - RNA, 642 nt, synthetic construct; identical to SEQ ID NO: 23149
  misc_feature 1..642: note = derived and/or modified sequence opt3 from Duligotuzumab_LightChain1
  source 1..642: mol_type = other RNA

SEQ ID NO: 23152 - RNA, 1353 nt, synthetic construct
  misc_feature 1..1353: note = derived and/or modified sequence opt3 from Dupilumab_HeavyChain1
  source 1..1353: mol_type = other RNA
gaggtgcagctggtcgaaagcggcgggggactcgagcaacccggtggctcccttagactgtcttgcgccgggtcaggattcacctttagggactacgctatgacatgggttcggcaggcacctggcaagggtttggaatgggtgagtagcatctccgggtctggaggcaacacttattacgccgattcggtaaaaggccgcttcacgatttcacgagacaatagcaagaacaccttatatctgcagatgaatagtctacgtgcggaggatacagctgtgtactattgtgccaaagacagactctccataactatcaggccacggtactatgggctggatgtctggggacagggtaccacagtgaccgtttctagcgcatccactaagggcccgtcagtgtttccccttgccccttgcagtcgcagcacatctgaatccaccgctgcactggggtgtttggtcaaagactacttcccagagcccgtgacggtatcatggaacagcggagccctcaccagtggcgttcacacttttcctgctgtgctgcaatcttccggtctgtacagcctctcgtctgtcgtgacagtgccatcctcaagtttagggactaagacctatacatgcaatgtcgatcataagcccagcaacaccaaagttgacaagagagtggagtccaaatacggacctccatgtccgccctgccctgccccagagttcctgggcggcccctctgtatttcttttccctccaaagcccaaagatacgttgatgattagcaggactccggaggtgacatgtgtcgtggttgacgtgtcacaggaagatcctgaggtccagtttaattggtatgtggacggggtagaggttcacaacgcgaagaccaagccccgggaagaacagttcaatagtacttaccgcgtggtctccgtgctgacagtcctacatcaagattggctcaacggaaaagaatataagtgcaaagtgagcaataagggtctgccatcttcaatcgagaaaaccattagtaaggcaaaaggccagcctcgagaaccccaggtttacacgcttccacccagccaggaggagatgaccaagaaccaagtgtccctgacatgtttggtaaaggggttttatccttctgacatcgccgtcgaatgggagtcgaatggacagccagaaaacaattacaaaactaccccgcccgtgctcgacagcgatggctccttctttctgtactcaagattaacagttgacaagagtaggtggcaggagggtaacgtgttctcttgcagcgtcatgcacgaagctctgcataaccactatactcaaaaatccctctcacttagcctgggg

SEQ ID NO: 23153 - RNA, 657 nt, synthetic construct
  misc_feature 1..657: note = derived and/or modified sequence opt3 from Dupilumab_LightChain1
  source 1..657: mol_type = other RNA
gacatcgtgatgacccagagccccctgtccctccctgtcacaccaggcgagccggcctctatttcatgcagaagtagccaatcccttctgtactctatagggtataactacttggattggtatttacagaagtcgggacagtcaccccagctgctaatctacctcggtagcaatagggctagtggcgttcctgaccggttctccgggtctggaagcggcactgattttacgctgaaaatttcccgcgtggaagcagaggacgtaggtttctattactgtatgcaagcccttcagaccccatatacatttgggcagggaactaagctggaaatcaaacgaaccgtggcggctccctcagtcttcatttttcctccaagtgatgagcagctcaagagcggcacagcctctgtggtttgcttgctgaacaatttctacccccgtgaagcaaaagtgcaatggaaggtcgacaacgccctgcagtccggcaattcacaggagagcgtgaccgagcaggatagtaaggactctacttactccctcagctcgacattaaccctgtctaaagctgattatgaaaagcacaaagtatacgcatgtgaggttacgcatcaagggctttcctcacctgtgactaagagttttaacagaggagaatgc

SEQ ID NO: 23154 - RNA, 1353 nt, synthetic construct
  misc_feature 1..1353: note = derived and/or modified sequence opt3 from Durvalumab_HeavyChain1
  source 1..1353: mol_type = other RNA
gaggtgcagctggtcgaaagcggcgggggactcgttcaacccggtggctcccttagactgtcttgcgccgcttcagggttcacctttagtaggtactggatgagctgggtgcggcaggcacctggaaagggcttggagtgggtagccaacatcaaacaggacggttccgaaaagtattacgtggattctgtcaaagggcgcttcacaatttcgcgagacaatgcgaagaactcattatatctgcagatgaatagcctacgtgctgaggatactgccgtgtactattgtgcaagagaaggaggctggtttggcgagctcgccttcgactactgggggcaaggaacgctggttaccgtgagttccgcttctacaaaaggtccaagcgtctttccgcttgcaccctcctcaaagagtactagcggcgggaccgccgctctgggatgcttggtgaaggattatttccctgagccagtaacagtttcttggaactccggcgccctcacctcaggtgtgcacacttttcccgcggtcctgcagagcagtgggctgtactctctctccagcgtggtgacagtcccttcgtcttccttaggaacccagacgtacatatgtaatgttaaccataaaccatcaaatactaaggtggacaaaagggtagaacccaagagttgcgataaaacccacacatgtcctccatgcccggcacccgagttcgaaggcggccctagcgtgtttctgttcccacccaagcctaaggacactcttatgatctcccggaccccagaggtcacatgtgtggttgtggatgtctctcatgaggaccccgaagtgaaatttaactggtatgtagatggggttgaggtgcacaatgccaagaccaaaccgcgcgaggaacagtacaacagcacgtatagagtcgtgtcagtcttgactgtgctgcatcaagactggctaaatggaaaggaatacaaatgcaaggttagtaacaaagctctccctgcctccattgagaagacaatcagcaaggcaaaaggtcagcccagggagccacaggtgtataccctgcctccctctcgggaagagatgactaagaatcaggtatcacttacatgtctggtcaaaggcttctacccaagtgatattgctgtggaatgggagagcaacgggcaacccgaaaataactataagaccacgcctccagttttggactccgacggatcgtttttcctctactctaaactgaccgtggataagagccgctggcagcagggcaacgtcttctcctgctcagtgatgcacgaggccttacacaatcattacacacaaaagagtctgtctctcagcccgggtaaa

SEQ ID NO: 23155 - RNA, 645 nt, synthetic construct
  misc_feature 1..645: note = derived and/or modified sequence opt3 from Durvalumab_LightChain1
  source 1..645: mol_type = other RNA
gagatcgtgctgacccagagccccggcacactctccctttctcctggggaaagagccactctgtcatgcagggctagtcaacgggtcagctcctcttacttggcatggtatcagcagaagccaggacaggccccgcgcttactgatttacgacgcgtcgtcacgagctacgggtatacccgatcgtttcagcggcagtgggtccggaaccgactttacactaactatctctagactcgagcctgaagatttcgccgtttattactgtcaacagtatggcagcctgccatggacctttggtcaggggacaaaagtggagattaagaggaccgtagcagccccctccgtgttcatctttcctccatcagacgaacagcttaaaagtggaactgctagcgtcgtgtgcctgttgaacaatttctacccccgggaggcaaaggttcaatggaaagtggataacgccctccagtctggcaattcccaggagtcagtcacagaacaggacagcaaggatagtacctattctctgtccagcacgctgactctctcgaaggctgactacgagaaacacaaggtgtacgcctgtgaagtaacccatcaaggcttatcttcccctgttacaaaatcatttaaccgcggggagtgc

SEQ ID NO: 23156 - RNA, 1338 nt, synthetic construct
  misc_feature 1..1338: note = derived and/or modified sequence opt3 from Dusigitumab_HeavyChain1
  source 1..1338: mol_type = other RNA
caggtgcaactggtccagagcggcgccgaggttaagaaacccggggcttccgtgaaggtatcttgcaaagcatcaggatacaccttcacaagttatgacatcaactgggtgagacaggccactggtcagggcctcgaatggatggggtggatgaatcctaacagcggaaatacgggctacgcgcaaaagtttcagggtagggtcaccatgacacggaacacttccatttctaccgcttatatggagctttcgtcactgcgcagcgaagatacagccgtgtactattgtgcacgagacccatactattactactatgggatggatgtttggggacagggcaccactgtgacagtcagttccgcctctaccaaaggcccgagcgtgttccccttggctccttgctcccgttcaacgagtgagagcactgcagccttagggtgtctggtaaaggactactttccagaacccgttaccgtgtcttggaactccggagctctaacatcaggtgtccacactttccctgccgtgctccagagcagtggcctgtattctctttccagcgtggtcaccgttccatcgtctaattttgggacacaaacctacacgtgcaatgtggatcataagccctccaacactaaagtagacaagacagtggagagaaaatgttgcgtcgagtgtcctccatgcccggcgccccctgtggcaggaccatcagttttcctgtttccccctaagccaaaagataccttgatgataagtaggactcccgaagtgacatgtgtcgtggtagacgttagccacgaggatccggaagtgcagttcaattggtatgtcgacggcgtggaggtccataacgccaagaccaagcctcgggaggaacagtttaattccacgttccgcgtggtttctgtgctcaccgtagtccaccaggattggctgaacggtaaagagtacaagtgcaaagtgagcaataaggggctgcccgctccaatcgaaaagacaatttcaaagactaaaggacaacctagagagccccaggtttataccctcccacccagtagggaagagatgacaaagaaccaggtgtccttaacttgtctggtcaagggcttttaccctagcgacatcgccgtggagtgggaatctaatggccaaccagagaacaactacaaaaccacaccgcccatgcttgattcagacgggagtttctttttgtatagcaagctgaccgtagacaaatcccggtggcagcagggaaatgtgttctcttgctcggttatgcatgaagcactacacaaccactacactcagaaaagcctctccctgtcacctggtaaa

SEQ ID NO: 23157 - RNA, 651 nt, synthetic construct
  misc_feature 1..651: note = derived and/or modified sequence opt3 from Dusigitumab_LightChain1
  source 1..651: mol_type = other RNA
cagagcgtgctgacccaacccccttccgtctctgccgctccaggccagaaggttacaatctcatgcagtgggagctcctctaacattgagaataaccacgtgtcgtggtaccagcagctcccgggaactgcacccaaacttctgatatatgacaataacaagagaccttcaggtatcccagataggttcagcggcagtaaatccgggacgtctgccaccttgggaattacaggcttacaaactggtgacgaagcggattactattgtgagacctgggacacaagcctgtccgctgggcgggtatttggaggcggcaccaagctaactgtgctcgggcagcccaaagccgcaccttcagtcacactgttcccacccagtagcgaagaacttcaggccaataaggctaccctggtgtgcttgatctctgatttttaccctggagcagttacggtggcctggaaggctgactcctcaccagtcaaagccggtgtggaaactaccacaccgagcaagcagagtaacaataaatatgcggcatcttcctacctcagcctgactcccgagcaatggaagtcgcatcgctcttattcctgtcaggtaacccacgagggctcaacagttgagaaaaccgtggcccctacggagtgcagt

SEQ ID NO: 23158 - RNA, 1347 nt, synthetic construct
  misc_feature 1..1347: note = derived and/or modified sequence opt3 from Ecromeximab_HeavyChain1
  source 1..1347: mol_type = other RNA
gaggtgaccctggtcgaaagcggcggggacttcgttaagcccggaggttccctcaaagtgtcttgcgccgcttcaggctttgcattcagtcactacgccatgagctgggtaagacagactcctgcgaagaggcttgagtgggtggcttatatctcctctgggggatcgggcacatactattcagatagcgtcaaaggtcggtttacgattagtcgcgacaacgccaagaataccctgtacttgcaaatgcgatccttacgttctgaagatagcgcaatgtatttctgtacaagagtgaaactggggacttactattttgactcctggggacagggcaccacactaaccgtttcaagtgccagcactaagggcccatctgtgttcccgctcgctccctcctcaaagagcacaagtgggggaaccgcagccctgggttgccttgtcaaagattactttcctgagccagtgacggtatcttggaactccggcgctctgactagcggggttcataccttccccgccgtgttgcagtcgtctggactctactccctgtcaagtgtcgtgacagtgcctagctcctctctgggcactcagacctatatatgtaatgtcaaccacaagccaagcaatacaaaagttgacaagaaagtggaacccaagtcatgcgataagacccatacgtgtcctccatgcccggcgcccgagctcttaggtgggcctagtgtatttctgttcccacccaaacctaaggacactcttatgatctccaggacaccagaggtgacctgtgtcgtggttgatgtgagccacgaagaccccgaggtcaaatttaactggtacgtggatggagtagaagttcataatgcaaagactaaaccgcgggaggagcaatataactctacataccgcgtggtctcagtgttgaccgtcctgcaccaggactggctaaatggcaaggaatataaatgcaaggtgagtaacaaggccctccctgctcccattgagaaaacgatcagcaaggccaaaggccagccaagagaacctcaggtttacaccctgcccccatccagggatgagcttacaaagaatcaagtgtctctgacttgtttggtaaaagggttctatccctcggacattgcagtcgaatgggagagcaacggacagcctgagaataactacaagaccacaccaccggtgctcgactccgatggttcatttttcctgtacagtaagttaactgttgacaaatctcggtggcagcagggcaatgtgttcagctgctccgtcatgcacgaagctctgcataaccactatacccaaaagtcactcagcctttctcccgggaaa

SEQ ID NO: 23159 - RNA, 642 nt, synthetic construct
  misc_feature 1..642: note = derived and/or modified sequence opt3 from Ecromeximab_LightChain1
  source 1..642: mol_type = other RNA
gacatccagatgacccaaacagccagctccctgcccgcttctctcggcgatagagtgactatttcatgcagtgcaagccaggacatatccaactaccttaattggtatcagcagaagcctgatgggacggtcaaactgttgatcttctactcttcgaacttacactcaggagttccaagcaggtttagtggtggcgggtccggaaccgactattctctgacaattagcaatctagagccggaagatatcgccacttacttctgtcatcaatattccaagctcccctggacctttggcggtgggacaaaactggagattaagcggaccgtggcggctccttcagtattcatctttccacccagtgacgaacagcttaaaagcggaactgcctctgtggtctgcctgttgaacaatttctaccctcgcgaggcaaaggtgcagtggaaggttgataacgccctccagtccggcaattcacaagaaagcgtgacagagcaggacagtaaagattctacctattccctgagctcgacgctgactctctctaaggctgactacgagaaacacaaggtctacgcatgtgaagtgacccatcagggcttatcctcaccagtaacaaaaagttttaaccgaggggagtgc

SEQ ID NO: 23160 - RNA, 1341 nt, synthetic construct
  misc_feature 1..1341: note = derived and/or modified sequence opt3 from Eculizumab_HeavyChain1
  source 1..1341: mol_type = other RNA
gtgcagctggtccaaagcggcgccgaggttaagaaacccggggcttccgtgaaggtatcttgcaaagcatcaggatacatcttcagtaactattggattcagtgggtgagacaggcccctggtcagggcctcgaatggatgggggagatacttccaggaagcggctccaccgaatacacagagaattttaaggacagggtcactatgacgcgggatacctctacatcgactgtgtatatggaactgtcaagccttcgcagtgaggacaccgcggtttactattgtgctcgatacttctttggttcctctccgaactggtatttcgatgtgtgggggcaaggaacattagtcaccgtgagctccgcctcaactaaaggccccagtgtatttcctctggcaccatgcagccgttctacatccgagtcaaccgccgctctaggctgtctcgttaaggactacttccccgaacctgtgacggtcagctggaatagtggggcactgacttctggagtgcacacctttccagccgtgcttcagtccagcggtctgtactcgttgtcttccgtcgttacagtgccctcaagtaacttcggcactcagacctatacatgcaatgtagatcataagcctagcaacaccaaagtggacaagacggtcgagagaaaatgttgcgtggaatgtccaccgtgccccgctcctccagttgccgggccctccgtgtttctcttccctccaaagcccaaagatactctgatgatctctaggacaccggaggtcacctgtgtggtagttgacgtgagccaggaggatcctgaagtccaatttaattggtacgtggacggagtcgaggtgcacaacgcgaagactaagccccgggaggaacagttcaattcaacatatcgcgttgtgagtgtactgaccgtcctccatcaggattggttaaacggcaaagaatacaagtgcaaagtgtccaataagggtctgccaagctctattgagaaaacgatctcaaaggcaaaagggcagcctagagagccccaagtttatacccttccacccagtcaggaagagatgacaaagaaccaggtgagcttgacttgtctggtcaagggattttacccttccgacattgccgtggaatgggagtctaatggccaaccagaaaacaattataaaaccacaccgcccgtactagattcggacggcagcttcttcctctactccaggctgactgtggacaagtcacggtggcaggaggggaacgtttttagttgctctgtcatgcacgaggctttgcataaccactacacccagaaaagcctgtccttgtcactcggaaag

SEQ ID NO: 23161 - RNA, 642 nt, synthetic construct
  misc_feature 1..642: note = derived and/or modified sequence opt3 from Eculizumab_LightChain1
  source 1..642: mol_type = other RNA
gacatccagatgacccaaagcccctcctctctgtcagccagtgtgggcgatagagtcacaattacttgcggggctagcgagaacatatacggagcactcaattggtatcagcagaagcctggtaaagccccaaaacttctgatctacggcgcgacgaacttggctgacggggttccgtccaggttctctggatcgggctcaggtaccgattttacattaactattagcagtctgcagcccgaagacttcgccacctattactgtcaaaatgtgctaaacacacctctcacctttgggcagggaactaaggtagagatcaagcggacagtggcagccccatccgtcttcatttttcccccttctgatgaacagctgaaaagcggcaccgcttccgtggtttgccttctgaataacttctatccacgcgaggcaaaggtgcagtggaaggtcgacaatgccttgcaatcaggcaacagtcaggaaagcgtgacggagcaggattctaaagactccacttactcactcagcagtaccctgacactgtctaaggctgattatgagaaacacaaggtatacgcctgtgaagttactcatcaggggctctccagccccgtgaccaaatcgtttaatcgaggagagtgc

SEQ ID NO: 23162 - RNA, 375 nt, synthetic construct
  misc_feature 1..375: note = derived and/or modified sequence opt3 from Efalizumab_HeavyChain
  source 1..375: mol_type = other RNA
gaggtgcagctggtcgaaagcggcgggggactcgttcaacccggtggctcccttagactgtcttgcgccgcttcagggtacagtttcaccggacactggatgaattgggtgaggcaggcacctggcaagggtttggagtgggtagggatcatgattcatccaagcgactccgaaacacggtataatcagaaatttaaggatatacgcttcactatctctgtggacaaatcgaagaacacgttatacctgcagatgaactcactacgagccgaggataccgcggtctattactgtgctcgtattggaatctatttttacggcacaacttatttcgactacatttggggccaagggaccctcgtgacagttagcagt

SEQ ID NO: 23163 - RNA, 324 nt, synthetic construct
  misc_feature 1..324: note = derived and/or modified sequence opt3 from Efalizumab_LightChain
  source 1..324: mol_type = other RNA
gacatccagatgacccaaagcccctcctctctgtcagccagtgtgggcgatagagtcacaattacttgcagggctagcaagacgatatccaaatacctcgcatggtatcagcagaagcctgggaaagccccaaaacttctgatctactctggatcgaccttgcagtcaggtgttccgagccggttcagtggctccgggtctggaacagactttactttaaccattagctccctgcaacccgaggatttcgcgacatattactgtcagcagcacaacgaatatcctctaacctttggccagggtactaaggtggagatcaagcgc

SEQ ID NO: 23164 - RNA, 768 nt, synthetic construct
  misc_feature 1..768: note = derived and/or modified sequence opt3 from Efungumab_SingleChain_variable_fragment
  source 1..768: mol_type = other RNA
atggccgaggtgcagctggtcgaaagcggcgctgaggttaagaaacccggggaatccctcagaatctcttgcaagggatcaggttgtattataagtagctactggatctcctgggtgaggcaaatgcctggcaaagggcttgagtggatgggaaagattgacccaggcgattcttatatcaactactcgccgtcattccagggtcacgtaaccattagcgcagacaaaagtatcaatacagcctatctgcagtggaactccttgaaggcgtctgatactgctatgtactattgcgcccgcgggggacgggactttggcgatagcttcgactactggggccaggggacgttagtgaccgtctcctcaggaggtggcgggagtggaggcggtgggagcggaggcggcgggtctgatgtggttatgacacaatccccctcatttctgagcgcattcgtgggagaccgaataactatcacctgtcgtgccagttctggtatttccagatatctagcttggtaccagcaggcacctggcaaggccccaaaactcctgatctacgctgccagcacacttcagaccggggtcccctcgaggttttctggatccggctcaggtactgagttcacactgaccattaatagtttgcaacctgaagattttgcgacgtattactgccagcatctcaacagctatccactgactttcgggggcggaaccaaggtggacatcaaacgggcagccgctctggagcaccatcaccatcaccac

SEQ ID NO: 23165 - RNA, 1362 nt, synthetic construct
  misc_feature 1..1362: note = derived and/or modified sequence opt3 from Eldelumab_HeavyChain1
  source 1..1362: mol_type = other RNA
cagatgcaactggtggagagcggcgggggagtcgttcagcccggtagatccctcaggctttcttgcaccgcctcaggcttcacatttagtaacaatgggatgcactgggtgcggcaggctcctggaaagggcctggaatgggtagcagtgatctggttcgacggtatgaacaaattttacgtcgatagcgtgaaggggcgcttcactatttcccgagacaattctaaaaacacgttgtatttagagatgaactcgctgcgtgccgaagataccgcgatatactattgtgctagagagggagacggctcaggcatctactattactatgggatggatgtttggggacagggtacaactgtgaccgtcagcagtgcctccacaaagggcccatctgtgtttccgctagcacccagctccaaatcaaccagtgggggaactgccgctctcggctgcctggtaaaggactacttccctgaaccagttacagtgagctggaactctggtgcacttacctccggggtccatacgtttcccgccgtgctgcaatcaagcggattgtacagtctctcttccgtggtcactgttcctagctcgtctctgggcacccagacatatatttgtaatgtgaatcacaagccatccaatactaaagtagataagagggtggagcccaaatcatgcgacaagacccatacatgtcctccatgcccggctcccgagctgctcggcgggcctagtgtcttcttatttccacccaaacctaaggataccctgatgatcagccggacgccagaagtgacttgtgttgtggtcgacgtgtcccacgaggatcccgaagtaaagttcaactggtacgttgacggagtggaggtccataatgccaaaacaaagccgcgcgaggaacagtataactctacctacagagtggtcagcgtgcttactgttttgcaccaggattggctgaatggtaaagagtataagtgcaaagtgtcaaacaaggcgctacctgcacccattgagaaaacaatcagtaaggccaagggccaaccaagggaacctcaggtatacaccctgcccccatcccgggaagagatgacgaaaaatcaggtcagcctcacctgtcttgtgaaggggttttatccctctgacatagctgttgagtgggaatcaaacggacagcctgagaacaattacaaaacaactccaccggtgctggacagtgatggcagcttctttttgtactccaagctcaccgtcgacaaatctcgctggcaacagggtaacgtgttctcgtgcagcgtaatgcacgaagccctgcataatcactatacacagaagtccttatcactgagtcccgggaag

SEQ ID NO: 23166 - RNA, 648 nt, synthetic construct
  misc_feature 1..648: note = derived and/or modified sequence opt3 from Eldelumab_LightChain1
  source 1..648: mol_type = other RNA
gagatcgtgctgacccagagccccggcacactctccctttctcctggggaaagagccactctgtcatgcagggctagtcaaagcgtctcctcttcgtacttggcatggtatcagcagaaaccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaccaatttttaccttcgggcccggaacaaaagtggatatcaagagaaccgtagcagcccctagtgtgtttattttcccacccagcgacgagcagctgaaatctggcactgcttccgtcgtgtgccttctgaacaatttttaccctagggaagcaaaggttcagtggaaagtggataacgccttgcaatcaggcaatagccaggagagtgtcacagagcaggactctaaggattccacctatagcctctcgtctacgctgactctgtccaaggctgactacgaaaaacacaaggtgtacgcctgtgaggtaacccatcaggggctctcaagtccagttacaaagagcttcaaccggggagaatgc

SEQ ID NO: 23167 - RNA, 1341 nt, synthetic construct
  misc_feature 1..1341: note = derived and/or modified sequence opt3 from Elgemtumab_HeavyChain1
  source 1..1341: mol_type = other RNA
gaggtgcagctgctcgaaagcggcgggggacttgtccaacccggtggctccctgagattgtcttgcgccgcttcagggttcacctttagtagctacgcaatgtcctgggttaggcaggcccctggaaagggcttagagtgggtgtctgcgatcaactcgcagggtaaatcaacatattacgctgacagcgtaaaggggcggttcactattagtcgcgataattccaaaaacacgctgtatctacagatgaactctctccgagccgaagacaccgcagtgtactattgtgcccgttggggagatgagggctttgacatatggggccaagggacactggtcactgtgagctccgcttcaaccaagggaccaagtgttttcccgcttgcacccagctctaaatccacatcaggtggcaccgccgctctggggtgcttggtgaaggattactttcctgaaccagtcactgtgagctggaatagtggagccctcacatctggcgtacacaccttccccgcggttctgcagtccagcggtctgtattcgctctcttccgtggtcacggtgccttcaagtagcttagggactcagacctacatctgtaatgtgaaccataagccatccaatacaaaagtcgacaagagagttgagcccaaatcttgcgataagactcacacctgtcctccatgcccggcacccgagctgcttggaggccctagcgtgtttttgttcccacccaaacctaaggacacactgatgatttcaaggaccccagaagtaacgtgtgtggtcgtggatgttagtcatgaggaccccgaagtgaagtttaactggtacgtcgatggcgtggaggtacacaatgccaaaactaagccgcgggaggaacagtataactccacataccgcgttgtgagcgtcctaaccgtgctccatcaagactggctgaatgggaaagagtataagtgcaaagtctctaacaaggcccttcctgctcccatcgagaaaactatttcaaaggcaaagggacagccaagagaacctcaggtgtacacactgcccccaagtagggaagagatgaccaaaaatcaggttagcttgacgtgtctcgtgaagggtttctatccctccgatatcgctgtagagtgggaatctaacggccaacctgagaataactacaaaaccacaccaccggtcctggactcggacgggagctttttcttatattccaagctgactgtggataaatcacggtggcagcagggaaacgtttttagttgctctgtgatgcacgaagccctccacaatcattacacccaaaagagcctttccctgtcacccggcaag

SEQ ID NO: 23168 - RNA, 642 nt, synthetic construct
  misc_feature 1..642: note = derived and/or modified sequence opt3 from Elgemtumab_LightChain1
  source 1..642: mol_type = other RNA
gacatccagatgacccaaagcccctcctctctgtcagccagtgtgggcgatagagtcacaattacttgcagggctagccaggggatatccaactggctcgcatggtaccagcagaagcctggaaaagccccaaaacttctgatctatggtgcgtcttcgttgcaatcaggcgttccgagccggttcagtgggtccggatctggcacggactttaccttaacaattagctccctgcagcccgaggatttcgctacttactattgtcagcagtactcaagttttcctaccacattcggtcaagggaccaaggtggaaatcaagcgcactgtagccgcaccaagcgtgtttatttttcccccttctgacgagcagctaaaatccggaacagcctcagtcgtgtgcctcctgaataacttctatccacgagaagctaaggttcagtggaaggtggataatgcacttcagagcggcaacagtcaagagtctgtcaccgaacaggactccaaagatagcacgtactcgctgtcttccactttgaccctctcaaaggccgactatgagaaacacaaggtgtacgcttgtgaggtaacacatcagggcctgagtagccccgttactaaatccttcaatcgtggggaatgc

SEQ ID NO: 23169 - RNA, 1347 nt, synthetic construct
  misc_feature 1..1347: note = derived and/or modified sequence opt3 from Elotuzumab_HeavyChain1
  source 1..1347: mol_type = other RNA
gaggtgcagctggtcgaaagcggcgggggactcgttcaacccggtggctcccttagactgtcttgcgctgcttcagggttcgactttagtaggtactggatgagctgggtgcggcaggcacctggaaagggcttggagtggatcggtgaaattaacccagattcctctaccataaattatgccccgtcgttaaaagacaagttcatcatttcacgcgataacgcgaaaaatagcctgtacctacagatgaacagtctccgagctgaggacacagccgtatattactgtgcacgtcccgatgggaattattggtactttgacgtgtggggacagggcactctggtcacggtgtcctctgccagcaccaagggcccttccgttttcccacttgctccctcaagtaaaagcacatctgggggaactgcagccctgggttgcttggtgaaggattattttcctgaaccagtcaccgtgtcctggaactcaggcgctctcacaagcggggtacacaccttccccgccgttctgcaaagttctggactgtactccctcagctcggtggtcactgtgccttcttcctcattaggcacacagacctacatctgtaatgtgaaccataagccaagtaatacgaaagtcgacaagaaagttgagccgaagtcctgcgataaaactcacacctgtcccccttgcccagcgcccgagctgcttggtgggccttccgtgtttttgttcccacccaagccgaaggacacactgatgatttctagaactcctgaagtaacctgtgtggtcgtggatgttagccatgaggaccccgaagtgaaatttaactggtatgtcgatggagtggaggtacacaatgcaaagacaaaaccaagggaggaacagtacaactcaacctatcgggttgtgagtgtcctaacggtgctccatcaggactggctgaatggcaaggagtacaaatgcaaggtctccaacaaagcccttcctgctcccatcgaaaagactataagcaaggccaaaggccaaccacgcgagccccaggtgtatacactgcctccatctagagacgaattgaccaagaatcaggtttcactcacttgtctggtgaaagggttctacccgagtgatatcgcagtagagtgggagagcaacggacagcccgaaaacaattataagacaacccctccagtcttagactccgatggtagctttttcctgtactcgaaactcacggtggacaagtctaggtggcaacagggcaacgtttttagctgctcagtgatgcacgaggcccttcacaatcattacacccagaagagtctgtctttgagccccgggaaa

SEQ ID NO: 23170 - RNA, 642 nt, synthetic construct
  misc_feature 1..642: note = derived and/or modified sequence opt3 from Elotuzumab_LightChain1
  source 1..642: mol_type = other RNA
gacatccagatgacccaaagcccctcctctctgtcagccagtgtgggcgatagagtcacaattacttgcaaggctagccaggacgttgggatagcagtggcctggtaccagcagaaacctggaaaggtaccaaaactccttatctattgggcgtccacgaggcacaccggtgtgccggatcggttctctggctcggggtcaggaacagactttactctgaccattagcagtttgcaacccgaggatgtcgctacatactattgtcagcagtactcctcttatccttacaccttcggccagggtactaaggtggaaatcaaacgcacagttgccgcaccaagcgtgtttatttttcccccttccgacgagcaattaaagtcagggaccgccagtgtcgtgtgcctgctaaacaatttctatccacgagaagctaaggtacagtggaaagttgataacgcactccagagcggaaattctcaggagtccgtgacggaacaagactcaaaggatagcacttacagtctgtcttccacccttacactgagcaaagccgactacgagaagcataaagtctatgcttgtgaggtgactcaccagggcttgtcgtctcccgtgaccaagtccttcaaccgtggcgaatgc

SEQ ID NO: 23171 - RNA, 1338 nt, synthetic construct
  misc_feature 1..1338: note = derived and/or modified sequence opt3 from Emactuzumab_HeavyChain1
  source 1..1338: mol_type = other RNA
caggtgcaactggtccagagcggcgccgaggttaagaaacccggggcttccgtgaaggtatcttgcaaagcatcaggatacaccttcacaagttatgacatcagctgggtgagacaggcccctggtcagggcctcgaatggatgggggtcatttggactgatggaggcacgaactacgcgcaaaaacttcagggtagggtgaccatgacaactgacacctccacatctaccgcttatatggagctgcggtcgttgcgctcagatgacactgccgtttactattgtgcacgagatcagcgtttatactttgacgtgtgggggcagggaacaaccgtcacggtgagcagtgcctccactaagggcccatctgtattcccgctggctcccagctccaagtcaaccagtggcgggacagcagccctaggatgcctcgttaaggattattttcctgaaccagtgactgtcagctggaactctggtgctctgacctccggcgtgcacacattccccgccgtgcttcaatcaagcgggctgtacagtttgtcttccgtcgttaccgtgcctagctcgtctctcggaacgcagacttacatatgtaatgtaaatcataaaccatccaacacaaaggtggacaaaaaggtcgagcccaaatcatgcgataagacccacacttgtcctccatgcccggcgcccgaactgctgggcggtcctagtgtgtttctcttcccacccaagcctaaagacacattaatgatcagcagaaccccagaggttacgtgtgtggtcgtggatgtatcccatgaggaccccgaagttaagtttaattggtatgtggatggggtcgaggtgcacaacgcaaaaaccaagccgagggaggaacagtacaattctacatatcgggtcgtgagcgttctgactgtgcttcatcaggactggttgaacggaaaagagtacaagtgcaaagtatcaaataaggccctgcctgctcccattgaaaagaccatcagtaaagccaagggccaaccacgcgagcctcaggtctatacactacccccatccagagacgaactcactaaaaaccaggtgagcctgacctgtcttgttaagggcttctacccctctgatattgcagtggagtgggaatcaaatgggcaacctgagaacaattataaaacaaccccaccggtcctggacagtgatggtagctttttcttgtactccaagctcactgtggacaagtctaggtggcagcagggaaacgtattttcgtgcagcgtgatgcacgaggctctgcacaatcattacacgcagaaatccttatcactgagtcccggcaag

SEQ ID NO: 23172 - RNA, 639 nt, synthetic construct
  misc_feature 1..639: note = derived and/or modified sequence opt3 from Emactuzumab_LightChain1
  source 1..639: mol_type = other RNA
gacatccagatgacccaaagcccctcctctctgtcagccagtgtgggcgatagagtcacaattacttgcagggctagcgaggacgttaacacgtacgtgtcctggtatcagcagaagcctgggaaagcaccaaagctccttatatacgccgcgtctaatcggtataccggagtaccgtcgcgcttctcaggtagcggcagtgggacagattttactctgaccatctcctctttgcagcccgaagacttcgctacatactattgtcaacagagcttttcctaccctaccttcggacagggcactaaattagagattaagcgaacagtggccgcaccatcagtctttatctttccccctagtgatgaacagctgaaaagcggtaccgcctctgtggtttgcctactcaacaatttctatccacgtgaggctaaggtgcaatggaaggtcgacaacgcactgcagtccggaaattcacaggaaagcgtgacggagcaggatagtaaagactctacttactcccttagctcgaccctgacattgtctaaggccgattacgagaaacacaaggtatatgcttgtgaagttactcatcaagggctctcctcacccgtgaccaaaagtttcaacagaggcgagtgc

SEQ ID NO: 23173 - RNA, 1323 nt, synthetic construct
  misc_feature 1..1323: note = derived and/or modified sequence opt3 from Emibetuzumab_HeavyChain1
  source 1..1323: mol_type = other RNA
caggtgcaactggtccagagcggcgctgaggttaagaaacccggggcttccgtgaaggtatcttgcaaagcatcaggatacaccttcacagactattacatgcactgggtgagacaggcccctggtcagggcctcgaatggatggggagggtcaacccaaatcggcgcggaactacgtataaccaaaagtttgagggccgagtgaccatgacaactgataccagtacaagcaccgcgtacatggaacttcgttccctgagatctgacgatactgctgtttattactgtgccagggcaaattggttggactattggggtcaggggacaaccgtgacggtctcgtcagccagcactaaaggaccgagtgtgttccccttagctccttgctcccggtctaccagcgagtccacagcagccctgggctgtctagtaaaggattactttccagaacccgttactgtgtcatggaacagtggcgctctcaccagcggggtccatacattccctgccgtgctgcagtcttccggactttactcactgagcagtgtggtcaccgttccatcttccagcttgggtacgaagacttatacatgcaatgtggaccacaaaccctcgaacaccaaggtagataaacgcgtggagtctaagtacggccctccatgtccgccctgccctgcgccagaggcagccgggggaccctccgtctttctcttccctccaaaacccaaggacactctgatgatctcaagaacaccggaagtgacctgtgttgtggtcgatgtgagtcaggaggaccctgaagtacaatttaattggtatgttgatggcgtggaggtccataacgctaagacgaaacccagggaggaacagttcaatagcacctaccgggtggtctccgtgctgacagttctccaccaggactggttaaacggtaaggagtataaatgcaaggtgtctaataaagggctgccaagctcaattgaaaagactataagtaaagccaagggacagcctcgcgagccccaagtatacacccttccaccctcccaggaagagatgacaaagaaccaggtcagcttgacttgtctggtgaaaggcttttatccttctgatatcgcagttgagtgggaatcaaatggccaaccagagaacaattacaagaccacaccgcccgtgctagacagtgacgggagcttctttctctactcccgactgaccgtcgataaatctagatggcaggaaggaaacgtgttctcgtgcagcgtaatgcatgaggcccttcacaaccactatactcagaagtccctgtcattgagtctcggt

SEQ ID NO: 23174 - RNA, 645 nt, synthetic construct
  misc_feature 1..645: note = derived and/or modified sequence opt3 from Emibetuzumab_LightChain1
  source 1..645: mol_type = other RNA
gacatccagatgacccaaagcccctcctctctgtcagccagtgtgggcgatagagtcacaattacttgcagcgtttcctcttcggtgtcaagcatatacctccactggtatcagcagaagcctgggaaagctccaaaacttctgatctacagtacgtccaacttggcatctggagtaccgagcaggttctccggttcaggcagtgggaccgactttacattaactattagctctctgcagcccgaggatttcgccacctattactgtcaagtgtattccggataccctctaacatttggcggtgggaccaaggtcgaaatcaagcggactgtggcggctccatcagttttcatttttccccctagcgacgagcagctcaaaagtggaacagcctctgtggtctgcctgcttaataacttctatccacgcgaagcaaaggtgcagtggaaggtagataatgccctgcagtccggcaacagccaagagtcggttaccgaacaggactctaaagattccacgtactcattgagtagcactctcaccctgtccaaggctgactacgagaaacataaggtgtatgcatgtgaggtcacacaccagggcctgtctagccccgtgactaaatcatttaatcgaggggaatgc

SEQ ID NO: 23175 - RNA, 1344 nt, synthetic construct
  misc_feature 1..1344: note = derived and/or modified sequence opt3 from Emicizumab_HeavyChain1
  source 1..1344: mol_type = other RNA
caggtgcaactggtcgagagcggcgggggactcgttcagcccggtggctcccttagactgtcttgcgccgcttcagggttcacctttagttactatgacatccagtgggtgaggcaggcacctggaaagggcttggaatgggtaagctccatttctccatcgggtcaatcaacatactatcggcgcgaggtgaaagggcgattcactataagccgtgataacagtaagaatacgttatacctgcagatgaactccctaagagccgaagacaccgcggtctattactgtgctaggcggacaggacgcgagtatggcggcgggtggtactttgattactggggacagggtactctcgtgaccgtttctagcgcctccacaaaaggcccgtcagtgttccccctggcaccttgcagtagaagcacctctgaatccactgccgctcttgggtgtctggtcaaggactattttccagagcccgtgacagtatcatggaatagcggagcattgaccagtggcgttcacacgttccctgccgtgctccagtcttccggtctgtacagcctgtcgtctgtcgtgactgtgccatcctcaagtctcgggacccaaacatatacttgcaacgtcgatcataaacccagcaataccaaggttgacaagagggtggagtccaaatacggacctccatgtccgccctgccctgctccagaatttttaggcggcccctctgtattcctgtttcctccaaagcccaaagatacacttatgatcagccggaccccggaggtgacgtgtgtcgtggttgacgtgtcacaggaagatcctgaggtccagttcaactggtatgtggacggggtagaggttcacaatgccaagactaaaccccgcgaggaacagtacaacagtacatatcgagtggtctccgtgttgaccgtcctgcatcaagattggctaaatggaaaggaatacaagtgcaaagtgagcaacaagggtctcccatcttcaattgagaaaactatcagtaaggcgaaaggccagcctagagaaccccaggtttacacactgccacccagccaaaaggagatgaccaaaaatcaggtgtcccttacgtgtctggtaaaggggttttatccttctgacattgcagtcgagtgggaatcgaacggacagccagagaataactacaagaccacaccgcccgtgttggatagcgacggctccttctttctctattcaaaactgactgttgacaagagtaggtggcaggaaggtaatgtgttctcttgcagcgtcatgcacgaggccttacataaccggtacacccaaaaatccctgtcactcagccct

SEQ ID NO: 23176 - RNA, 1332 nt, synthetic construct
  misc_feature 1..1332: note = derived and/or modified sequence opt3 from Emicizumab_HeavyChain2
  source 1..1332: mol_type = other RNA
caggtgcaactggtccagagcggctccgagctcaagaaacccggggcctctgttaaggtgtcatgcaaagctagtggatacaccttcacagacaacaatatggattgggtaagacaggcacctggtcagggccttgaatggatgggggacatcaacactaggagcggaggctccatttataatgaggaatttcaagatcgggtgataatgacggtcgacaagtctaccgatacagcctacatggagctgtcgtcattgcgcagcgaagacactgcgacctatcactgtgctcgacgtaaaagttacggttattacttagatgagtggggagagggaacactggtgaccgtttcctctgccagcactaagggcccatccgtgttcccgctagcaccctgctcaagaagtacaagcgaatctaccgccgctctcggctgtctggtcaaggactattttcctgagccagtgacggtatcctggaactcaggggcacttactagcggagttcataccttccccgccgtgctgcagagttctggtttgtactccctcagctcggtcgtgacagtgccttcttcctcactgggcactcagacctacacatgcaatgtcgatcacaaaccaagtaacaccaaggttgacaaaagggtggaaagcaagtatgggcccccttgtccaccgtgccccgctcctgagtttctgggaggcccatccgtattcctctttccccctaaaccaaaggatacgttaatgatctctcggactcccgaggtgacatgtgtcgtggttgacgtgagccaggaagatccggaggtccaattcaattggtacgtggacggtgtagaagttcataacgccaagaccaaacctcgcgaggaacagtataattcaacttacagagtggtcagtgtgctgacagtccttcaccaggactggttgaacgggaaggagtataaatgcaaggtgtccaataaaggactgcccagctctattgagaagaccatctcaaaagcgaagggccagccaagggaacctcaagtttacacgctacccccaagtcaggaggaaatgaccaagaaccaggtgagcctcacatgtctggtaaaaggcttttatccctccgatattgcagtcgagtgggaatctaatgggcaacctgagaacaattacaagactaccccaccggtgcttgactcggatgggagcttctttctgtactccaaattgacagttgacaagtcacggtggcaggagggtaacgtgttcagttgctctgtcatgcatgaagccctccacaaccactatactcaggagagcctgtccttatcaccc

SEQ ID NO: 23177 - RNA, 642 nt, synthetic construct
  misc_feature 1..642: note = derived and/or modified sequence opt3 from Emicizumab_LightChain1
  source 1..642: mol_type = other RNA
gacatccagatgacccaaagcccctcctctctgtcagccagtgtgggcgatagagtcacaattacttgcaaggctagcaggaacatagagcggcagctcgcatggtaccagcagaaacctgggcaagccccagaacttctgatctatcaggcgtcccgcaaggagtctggagttccggaccgattctcgggttcacgttacggcacggattttaccttgacaattagcagtttacagcccgaagacatcgctacttattactgtcagcaatattccgatcctccactgaccttcgggggaggcacaaaagtggagattaagagaaccgtagccgcaccctctgtgtttatcttccctccaagcgacgaacagctaaaatccggtactgcctcagtcgtgtgcctcctgaataacttttaccccagggaggctaaggttcagtggaaggtggataatgcacttcagagtgggaacagccaagagtctgtcacagaacaggactccaaagattcaacctatagcctgagttctacgttgactctctccaaggccgactacgagaaacacaaggtgtacgcttgtgaagtaacccatcagggactgagctcgcctgttacaaaatctttcaatcggggcgagtgc

SEQ ID NO: 23178 - RNA, 1347 nt, synthetic construct
  misc_feature 1..1347: note = derived and/or modified sequence opt3 from Enavatuzumab_HeavyChain1
  source 1..1347: mol_type = other RNA
gaggtgcagctggtcgaaagcggcgggggactcgttcaacccggtggctcccttagactgtcttgcgccgcttcagggttcacctttagtagctactggatgtcctgggtgaggcaggcacctggaaagggcttggagtgggtagccgaaatccggttaaaatctgacaactatgcgacacactacgctgagtcggtgaagggtcgcttcactatttcacgagatgacagcaaaaatagtctgtatctacagatgaactccctccgtgccgaagatacggcagtctactattgtaccgggtactatgccgacgctatggattactggggacagggcacactggtgactgtttctagcgcatccaccaagggcccatcagtgtttccgcttgcccccagtagcaaatctacatccgggggaaccgctgccctgggttgcttggtcaaggactacttccctgagccagtgactgtatcatggaatagcggcgcgctcacaagtggggttcatacctttcccgcagtgctgcaatcttccggactgtatagcctctcgtctgtcgtgacggtgccttcctcaagtttaggcactcagacctacatatgtaacgtcaatcacaagccaagcaacacaaaagttgataagaaagtggagcccaagtcctgcgacaaaactcatacctgtcctccatgcccggcccccgaactgcttggtgggccttctgtattcttgtttccacccaagcctaaggatacactgatgatcagcagaaccccagaggtgacgtgtgtcgtggttgacgtgtcacacgaagatcccgaggtcaaattcaattggtatgtggacggagtagaggttcataacgctaagactaaaccgagggaggaacagtacaatagtacatatcgggtggtctccgtgctaaccgtcctccaccaggattggctgaacggcaaggaatacaaatgcaaggtgagcaataaagcccttcctgcacccattgagaagactatctctaaggctaaaggccaaccacgcgaacctcaggtttatacactgcccccatcaagagaggagatgaccaagaaccaggtgagtttgacgtgtctcgtaaaagggttttaccccagcgacattgccgtcgaatgggagtccaatggacagcctgaaaacaattacaagaccacaccaccggtgctggactctgatggttcgttctttttatatagcaaactgactgttgacaagtccaggtggcaacagggcaacgtgttctcatgcagtgtcatgcacgaggcgctccataaccactacacccagaagtctcttagcctgtcccccgggaaa

SEQ ID NO: 23179 - RNA, 654 nt, synthetic construct
  misc_feature 1..654: note = derived and/or modified sequence opt3 from Enavatuzumab_LightChain1
  source 1..654: mol_type = other RNA
gacatccagatgacccaaagcccctcctctctgtcagccagtgtgggcgatagagtcacaattacttgcagggctagccagtccgtttctacgtcgtcatacagctatatgcactggtaccagcagaagcctgggaaagcaccaaagctccttataaaatatgccagtaacctggagtccggagtgccgtctcggttcagcggttccggctcagggaccgactttacattgactatcagtagcttacaacccgaagatttcgcgacctactattgtcagcattcttgggagattccttacacatttggaggcggtaccaaggtagaaatcaaacgcactgtggctgccccatccgtcttcatttttcccccttcagacgagcagctaaagagcgggacagcaagtgtggtttgcctgctcaataacttctatccacgagaagccaaggtgcagtggaaagtcgataatgctctgcaatctggaaactcccaggagagcgtgaccgagcaggactcgaaggattctacgtactccctttcaagtactctgaccttgagcaaagcagactacgaaaagcacaaagtatatgcctgtgaggttacacatcagggcctctcctctcccgtgactaagagctttaatcgtggcgaatgc

SEQ ID NO: 23180 - RNA, 1341 nt, synthetic construct
  misc_feature 1..1341: note = derived and/or modified sequence opt3 from Enfortumab_HeavyChain
  source 1..1341: mol_type = other RNA
gaggtgcagctggtcgaaagcggcgggggactcgttcaacccggtggctcccttagactgtcttgcgccgcttcagggttcacctttagtagctacaacatgaattgggtgaggcaggcacctggaaagggcttggagtgggtatcctatatctcttcgtcaagcagtacaatttactatgccgactccgtgaaaggtcggttcactatatctcgcgataacgcgaagaatagcttatccctgcagatgaactcactacgagacgaagatacggctgtctactattgtgcccgtgcatactattacgggatggacgtgtggggacagggcaccacagttactgtgagtagcgcctctaccaaaggcccatccgtctttccgctcgctccctcaagcaagagtacatctgggggaaccgcagccctgggttgccttgtgaaagattacttccctgagccagtaactgtttcctggaatagcggcgctctgacatcgggggtgcacacctttcccgccgtcttgcaatcttccggactctattcactgagtagcgtggtgacggtcccttcctctagcctgggcactcagacctacatctgtaacgttaatcataagccatcaaacacaaaggtggacaaaagagtagaacccaagagttgcgataaaactcacacctgtcctccatgcccggcgcccgagctcttaggtgggccttccgtgttcctgtttccacccaagcctaaagacacacttatgattagcaggaccccagaggtcacgtgtgtggttgtggatgtctctcatgaagaccccgaggtgaagttcaattggtatgtagatggagttgaagtgcacaacgcaaagactaaaccgcgggaggagcagtacaattcaacatatcgcgtcgtgagtgtcttgaccgtgctgcatcaggactggctaaacggcaaggaatacaaatgcaaggttagcaataaagccctccctgctcccatcgagaagactatttccaaagccaagggccaaccaagagaacctcaggtgtatacactgcccccatctagggaggaaatgaccaagaaccaggtatcgcttacgtgtctggtcaaagggttttaccccagcgatatcgcagtggagtgggagtccaatggacagcctgaaaacaactacaagaccacaccaccggttttggactcagacggtagtttctttctctattctaaactgactgtggataagagccggtggcaacagggcaatgtcttctcctgctcagtgatgcacgaggctttacacaaccattacacccagaaaagcctgtctctctcccccgggaag

SEQ ID NO: 23181 - RNA, 642 nt, synthetic construct
  misc_feature 1..642: note = derived and/or modified sequence opt3 from Enfortumab_LightChain
  source 1..642: mol_type = other RNA
gacatccagatgacccaaagcccctcctctgtgtcagccagtgtcggcgatagagttacaattacttgcagggctagccaggggatatccggatggctggcatggtaccagcagaagcctggtaaagccccaaagttcctcatctatgcggcttctacgcttcaatcgggcgtgccgtcacggtttagcgggagtggatccggcaccgacttcacactgactatttctagcttgcagcccgaggattttgccacctactattgtcagcaggcaaactccttccctccaacatttggtgggggaaccaaagtagaaatcaagcgcactgtggccgctccctcagtcttcatttttcctccaagtgacgagcaattaaaaagcggcacagcatctgtggtttgcctgctaaataacttctacccccgagaagccaaggtgcagtggaaggtcgataatgctctccagtccggcaactcacaggagagcgtgaccgaacaagacagtaaagattctacgtattccctgagctcgactcttaccctgtctaaggccgactacgagaaacacaaggtatatgcgtgtgaggttacacatcaggggttgtcctcacctgtgactaaaagttttaatcgtggagaatgc

SEQ ID NO: 23182 - RNA, 1341 nt, synthetic construct; identical to SEQ ID NO: 23180
  misc_feature 1..1341: note = derived and/or modified sequence opt3 from Enfortumab_vedotin_HeavyChain1
  source 1..1341: mol_type = other RNA

SEQ ID NO: 23183 - RNA, 642 nt, synthetic construct; identical to SEQ ID NO: 23181
  misc_feature 1..642: note = derived and/or modified sequence opt3 from Enfortumab_vedotin_LightChain1
  source 1..642: mol_type = other RNA

SEQ ID NO: 23184 - RNA, 1356 nt, synthetic construct
  misc_feature 1..1356: note = derived and/or modified sequence opt3 from Enoblituzumab_HeavyChain
  source 1..1356: mol_type = other RNA
gaggtgcagctggtcgaaagcggcgggggactcgttcaacccggtggctcccttagactgtcttgcgctgcttcagggttcacctttagtagcttcggaatgcactgggtgaggcaggcacctggcaagggtttggagtgggtagcctacatctcctctgactcgtcagcgatttattacgctgatacagtgaaagggcggtttactataagccgcgacaacgccaagaatagtttatatctgcagatgaactccctacgagatgaagacacggcagtctactattgtggacgtggcagagagaatatctactatggctctaggctcgattactgggggcagggaaccacagtgactgttagctccgcctcaaccaaaggtccaagtgtgttcccgctggctcccagctctaagtccacatcaggcgggaccgcagcccttggatgcctggtcaaagactactttcctgaaccagtgactgtaagctggaacagtggcgctttgacatctggtgttcataccttccccgccgtgctccaatccagcgggctgtattcgctgtcttccgtcgtgacggtgccttcaagtagcctcggaactcagacctacatttgtaatgtcaaccacaagccatccaatacaaaggttgataaacgggtggagcccaagtcttgcgacaaaactcatacctgtcctccatgcccggcgcccgagttagtaggcggccctagcgtgtttctgcttccacccaagcctaaagatacattgatgatctcacgcaccccagaagtcacgtgtgtggttgtggacgtcagtcacgaggatcccgaagtgaagttcaactggtatgtagacggggttgaggtgcataatgcaaagactaaaccgcctgaggaacagtacaactccacactgagagtcgtgagcgtcctaaccgtgctccaccaggattggctgaatggaaaggagtataaatgcaaggtttctaacaaagcccttcccgctccaattgaaaagactatctcaaaagccaagggtcaacctagggagccccaggtgtacacactgccacccagtcgggaagagatgaccaagaatcaggtcagcttgacgtgtctcgtaaaaggcttttatccttccgacatagcagtggagtgggaatctaacgggcagccagagaataactacaagaccacaccgctggttttagactcggatggcagcttctttctgtactccaaactcactgtggacaagtcacgctggcaacagggaaacgtcttcagttgctctgtgatgcacgaagcccttcataatcactatacccagaaaagcctgtccttgtcacccggtaag

SEQ ID NO: 23185 - RNA, 642 nt, synthetic construct
  misc_feature 1..642: note = derived and/or modified sequence opt3 from Enoblituzumab_LightChain
  source 1..642: mol_type = other RNA
gacatccagctgacccaaagcccctccttcctctctgcctcagtgggcgatagagtcacaattacttgcaaggctagtcagaacgttgacacgaatgtggcatggtaccagcagaaacctgggaaggccccaaaagcgcttatatatagcgcttcctacaggtattctggagtaccgtcgcggttttcaggtagcggcagtgggaccgatttcacactgactatctcctctttgcaacccgaggactttgccacctactattgtcagcagtacaacaattatcctttcacatttggacagggcaccaagttagaaattaaacgcactgtggcagccccaagcgtcttcatctttcccccttccgatgagcaactgaagtcaggtacagctagtgtggtttgcctactcaacaatttctacccacgagaagcaaaggtgcagtggaaagtcgacaacgccctgcagagcggaaattctcaggagtccgtgaccgaacaagattcaaaggacagcacgtacagtctttcttccactctgaccttgagcaaagctgattatgagaagcacaaagtatacgcctgtgaggttacacatcaggggctctcgtctcccgtgactaagtcctttaaccgtggcgaatgc

SEQ ID NO: 23186 - RNA, 1356 nt, synthetic construct
  misc_feature 1..1356: note = derived and/or modified sequence opt3 from Enokizumab_HeavyChain1
  source 1..1356: mol_type = other RNA
caggtgcaactggtccagagcggcgccgaggttaagaaacccgggtcctctgtgaaggtatcatgcaaagctagtggaggtaccttcagctactattggatcgaatgggtgagacaggcacctggccaggggctcgagtggatgggagaaattcttccaggctccggtacaactaacccgaatgagaagtttaaagggagggtcacgataaccgccgacgaatctacatcgactgcgtacatggagctgagtagcttgcggagtgaggataccgctgtgtattactgtgcccgcgcagactattacggatccgattatgttaagttcgactactggggccaaggcacattagtgaccgtctctagcgcctccactaaggggccctcagtgtttcctctggctccaagtagcaaatctacatccggaggtaccgcagccctaggctgcctcgtaaaggattacttccccgaacctgttacggtgtcatggaacagcggggctctgacttcaggagtccacacctttccagccgtgcttcagtcttccggcctgtatagcttgtcgtctgtggtcacagttccctcctcaagtctcggtactcagacctacatctgtaatgtgaaccataaacctagcaatacaaaggtagacaaacgagtggagccaaagtcctgcgataagacccacacgtgtccgccctgccctgcgccagaactgctcgggggaccctctgtcttcctgtttcctccaaaacccaaggacactttaatgattagccgtacaccggaggtgacctgtgttgtggtcgatgtgtcacatgaggaccctgaagtaaaattcaactggtatgttgatggcgtggaggtccacaatgcaaagactaaacccagagaggaacagtacaacagtacatatagggtggtctccgtgctgaccgttcttcatcaagactggttgaatggcaaggaatacaaatgcaaggtgagcaacaaggccctgccagctcctatcgagaaaacgatttctaaggccaaagggcagccccgggagccacaggtatataccctacccccttcacgcgaagagatgacaaagaatcaggtcagtctcacttgtctggtgaaaggattttacccaagcgatatcgcagttgaatgggagtccaacggtcaaccggaaaataactacaagaccacaccccctgtgcttgactctgacggctcgttctttctgtatagcaagttgactgtcgataaatccagatggcagcaggggaatgtgttctcatgcagtgtaatgcacgaggctctccacaaccattacacccaaaagtctctgagcttatccccaggaaaa

SEQ ID NO: 23187 - RNA, 642 nt, synthetic construct
  misc_feature 1..642: note = derived and/or modified sequence opt3 from Enokizumab_LightChain1
  source 1..642: mol_type = other RNA
gacatccagatgacccaaagcccctcctctctgtcagccagtgtgggcgatagagtcacaattacttgcaaggctagccagcacgttataacgcatgtgacctggtaccagcagaaacctgggaaggcaccaaaactccttatctatggaacatcctactcttattcgggtgtaccgtcaaggttcagcggcagtgggtccggaactgactttaccctgacaatttctagcttgcaacccgaggatttcgccacctactattgtcagcagttttacgaatatcctttaactttcggcggtgggacaaaggtggagatcaaacggaccgtcgcggctccatccgtgtttatttttcccccttcagacgaacagctgaagagtggaacggccagcgttgtgtgcctactcaacaatttctacccacgcgaggcaaaggtccaatggaaagtggataacgccctgcagtctggcaattcccaggaatcagtaactgagcaggacagcaaggatagtacctactctctttccagcacactgactttgtcgaaagctgactatgagaagcacaaagtttacgcatgtgaagtgacccatcaaggcctctcttcccccgtcacaaagtcattcaaccgaggggagtgc

SEQ ID NO: 23188 - RNA, 612 nt, synthetic construct
  misc_feature 1..612: note = derived and/or modified sequence opt3 from Enokizumab_LightChain
  source 1..612: mol_type = other RNA
gacatccagatgacccaaagcccctcctctctgtcagccagtgtgggcgatagagtcacaattacttgcaaggctagccagcacgttataacgcatgtgacctggtaccagcagaaacctgggaaggcaccaaaactccttatctatggaacatcctactcttattcgggtgtaccgtcaaggttcagcggcagtgggtccggaactgactttaccctgacaatttctagcttgcaacccgaggatttcgccacctactattgtcagcagttttacgaatatcctttaactttcggcggtgggacaaaggtggagatcaaacggaccgtcgcggctccatccgtgtttatttttcccccttcagacgaacagctgaagagtggaacggccagcgttgtgtgcctactcaacaatttctacccacgcgaggcaaaggtccaatggaaagtggaatctgtaactgagcaggattccaaggactcaacctacagcctgagttctacacttactctgtccaaagccgattatgagaagcacaaagtttacgcttgtgaagtgacccatcagggcttgagctcgcccgtcacaaagtctttcaaccgaggcgagtgc

SEQ ID NO: 23189 - RNA, 1356 nt, synthetic construct
  misc_feature 1..1356: note = derived and/or modified sequence opt3 from Enoticumab_HeavyChain1
  source 1..1356: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtgtccttcttgtggtatgacggtacaaacaaaaattacgtcgagtctgtgaaggggcgctttactatctcgcgagataactctaaaaatatgttatatctggaaatgaacagcctacgtgccgaggacacggcggtttactattgtgctagagatcatgacttcaggagtggatacgaaggctggtttgatccatggggccaggggaccctcgtgacagtctcctctgccagcactaagggaccgtccgtgttccccctggcaccttcaagtaaaagcacctctggtggcacagccgctcttgggtgcctggtaaaggactattttccagagcccgttaccgtgtcctggaactcaggagcattgactagcggcgtccacacattccctgccgtgctccaaagttctggtctgtactccctgagctcggtggtcaccgttccatcttcctcactcgggacgcagacttacatttgtaatgtgaatcataagcccagtaacaccaaagtagataagaaagtggagcctaagagctgcgacaaaacacacacttgtccaccgtgccccgctcctgaattactgggaggcccatccgtctttctttttccccctaagccaaaggataccttgatgatatctcggacacccgaggtgacctgtgttgtggtcgacgtgagccatgaagatccggaggtaaaattcaattggtatgttgacggcgtggaggtccacaacgccaagacgaaacctcgcgaggaacagtacaattcaacttatagagtggtcagtgtgctgacagttctacaccaggattggctcaacgggaaggaatacaaatgcaaggtgtccaataaagcgctgcccgcaccaatcgagaagaccattagcaaggccaaaggacaacctagggaaccccaggtatatactcttccaccctctcgggacgagctgacaaagaaccaggtctcattgacctgtctcgtgaaaggtttctaccctagtgacatcgctgttgagtgggaaagcaatggccagccagagaacaactataagacgaccccgcccgtgctggattccgacgggtcatttttcttatactcgaaactgacagtcgataagagccgctggcaacagggaaatgtgttctcctgctcagtaatgcatgaagccctccacaaccattacactcagaagagtctttctctgagccctggc

SEQ ID NO: 23190 - RNA, 642 nt, synthetic construct
  misc_feature 1..642: note = derived and/or modified sequence opt3 from Enoticumab_LightChain1
  source 1..642: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacaccgtagcaattggccacccacctttggaggcggtacaaaagtggagattaagagaaccgtagctgcaccttccgtgttcatctttccaccctcagatgaacagctgaaaagtgggactgccagcgtcgtgtgccttctgaacaatttctatcctagggaggctaaggttcagtggaaagtggacaacgccttgcagtctggaaattcccaagagtcagtcacagaacaggatagcaaggacagtacctactctctctccagcacgctgactctgtcgaaggcggattatgagaaacataaggtgtacgcatgtgaagtaacccaccagggcctctcttccccagttacaaaatcatttaaccggggcgagtgc

SEQ ID NO: 23191 - RNA, 1329 nt, synthetic construct
  misc_feature 1..1329: note = derived and/or modified sequence opt3 from Ensituximab_HeavyChain1
  source 1..1329: mol_type = other RNA
caagtgcaactgaaggagagcggccccgacctcgtcgccccttcccagtctctttcaattacctgcacagttagtgggttcagcctgtccaaatttggagtgaactgggtaagacagccaccgggtaagggcttggaatggttaggggtgatctggggagatggctctacttcgtacaattcaggtctgataagcaggctaagtatctccaaagagaactctaagagccaggtcttcctcaaactgaatagccttcaagctgacgatacggcaacctattactgtgtgaagcccgggggagactattggggccacggcacatcagttactgtgagtagcgcctctaccaaggggccttccgtctttccactggcgccctcaagcaaaagtacatctggaggtaccgctgccttgggctgcctcgtgaaggattacttccctgaaccagtaactgtttcctggaacagcggggcactgacatcgggagtgcatacctttcccgccgtcctgcagtcttccggcccttattcactcagtagcgtggtgacggtcccatcctctagcttaggtactcagacctacatttgtaatgttaaccacaaaccgtcaaatacaaaggtggacaaaaaggtagagcccaagagttgcgataaaactcatacctgtcctccatgccccgctcctgaactgcttgggggaccatccgtgttcttgtttcccccgaagcctaaagacacactgatgatcagccggacccccgaggtcacgtgtgtggttgtggatgtctctcacgaggacccagaagtgaagttcaactggtatgtagatggcgttgaggtgcataatgcaaaaactaagcctcgcgaggaacagtacaactcaacataccgagtcgtgagtgtcctaaccgtgctccaccaagactggctgaatggcaaagagtataagtgcaaggttagcaacaaagcccttcccgctccaattgaaaagactatctccaaagccaaggggcagccccgtgagcctcaggtgtacacactgccaccgtctagagatgaattgaccaaaaatcaggtatcgctcacgtgtctggtcaagggattttatcccagcgacatagcggtggagtgggaatccaacggtcaacctgagaataactacaagaccatgccacccgttttagactcagatggcagtttctttctgtattctaaactcacagtggacaagtccaggtggcagcaggggaacgtcttctcctgctcagtgatgcacgaggcacttcataatcactacactcagaaaagcctgtctttgtcccctggaaag

SEQ ID NO: 23192 - RNA, 639 nt, synthetic construct
  misc_feature 1..639: note = derived and/or modified sequence opt3 from Ensituximab_LightChain1
  source 1..639: mol_type = other RNA
caggtggtcctgacccaaagccccgttatcatgtccgcctctcctggcgagaaggtgacaatgacttgctcagctagtagctccatttcttacatgtattggtaccagcagaaaccagggacgtcgccgaagagatggatatatgacacctcaaaactcgcaagcggagtacccgccaggttcagtggttccggctctgggacaagctactcccttactatctcaaacatggaagcgggagatgctgccacctattactgtcaccagcgggacagttatccttggacatttggcggtgggaccaatctggagattaagcgcactgtggcagccccaagcgtcttcatctttcccccttctgatgaacaattgaaatccggaacagcttcagtggtttgcttactgaacaatttctacccacgagaggcaaaggtgcagtggaaggtcgacaacgccctacagagcggcaatagtcaggaatctgtgaccgagcaagattccaaagacagcacgtactcgctctcttccactctgaccctttcaaaggctgattatgagaaacataaggtatacgcctgtgaagttacacaccagggcctgagtagccccgtgactaaatcctttaaccgtggggagtgc

SEQ ID NO: 23193 - RNA, 768 nt, synthetic construct; identical to SEQ ID NO: 23164
  misc_feature 1..768: note = derived and/or modified sequence opt3 from Ensituximab_SingleChain_variable_fragment
  source 1..768: mol_type = other RNA

SEQ ID NO: 23194 - RNA, 987 nt, synthetic construct
  misc_feature 1..987: note = derived and/or modified sequence opt3 from Entolimod_chain1
  source 1..987: mol_type = other RNA
atgagaggcagccaccatcaccatcaccatgggatggcctccatgaccggaggtcagcaaatgggcagggacctgtacgatgacgatgacaaggatcccatggctcaggtgatcaacacaaattctctctcacttctgactcagaacaatttgaacaaaagtcagagctccttatcttcggcaattgagcggctgtcaagcgggctacgcataaatagtgccaaggacgatgcggctggacaagccatcgcaaaccgattcacgtccaatattaaaggcctcacccaggcctctcgtaacgctaatgacggtatcagcattgcacagacaactgaaggggccctgaacgagatcaataacaatcttcagagagtcagggaactgtccgttcaagctaccaacggaacaaattcagatagtgacctcaagagcatacaggatgagatccagcagcggttggaagagattgaccgcgtgtctaaccaaacccagtttaacggcgtaaaagtgctgtcccaggataatcaaatgaagatccaggtcggcgccaacgacggggagactattacaatcgacctgcagaagatagatgtgaaatcactcggattagacggtttcaatgttaacagccctggcattagtgggggaggcggtgggatcctggattctatgggaacccttattaatgaagacgcggcagccgctaagaaatccacggccaacccattggcaagcatcgattcggctctgtctaaggtggacgccgtcagatcctcactaggcgcgatccagaataggtttgatagtgccattactaacctcggcaataccgtgacaaacctgaatagcgcacggtcccgcatagaggacgctgattatgccactgaagtatctaacatgagcaaagctcaaatccttcagcaggccgggacctcagttctggcacaggccaatcaagtgccgcagaacgtcttgagtctcctgcga

SEQ ID NO: 23195 - RNA, 1338 nt, synthetic construct
  misc_feature 1..1338: note = derived and/or modified sequence opt3 from Epratuzumab_HeavyChain
  source 1..1338: mol_type = other RNA
caggtgcaactggtccagagcggcgccgaggttaagaaacccgggtcctctgtgaaggtatcatgcaaagctagtggatacaccttcacaagctattggctccactgggtgagacaggcacctggtcagggccttgaatggatcgggtacattaacccaaggaatgactatactgagtacaaccaaaattttaaggataaagccacgataaccgcggacgaatccacaaacactgcttatatggagctgtcttcgttgcggtcagaagataccgccttctacttttgtgcacgccgagacatcacaaccttctattggggacagggcactttagtcacagtgagcagtgcctccaccaagggtccgtctgtttttcccctggctcctagctccaagtcaacgagtgggggaactgcagccctaggctgcctcgtgaaagattacttcccagagcccgtcaccgtgagctggaactctggcgctctgacatccggggtacatacttttcctgccgttcttcagtcaagcggactgtacagtttgtcttccgtggtcaccgtgccaagctcgtctctcggtacacagacctatatttgtaatgtgaatcacaagccctccaacacgaaagtcgacaagaaagttgagcctaagtcatgcgataagactcatacatgtccaccgtgccccgcgcctgaactgctgggcgggccaagtgtgttcctctttccccctaaaccaaaggacaccttaatgatcagccgtactcccgaggtaacatgtgtggtcgtggatgtttcccacgaagacccggaggtgaaattcaattggtacgtcgatggagtggaggtacataacgcaaagaccaaacctagagaggaacaatataattctacgtacagggttgtgagcgtcctgaccgtgcttcaccaggactggttgaacggcaaggaatataaatgcaaggtctcaaataaggccctgcccgctccaattgagaaaacaatcagtaaggccaaaggtcagcctcgggaaccccaggtgtacactctaccaccctcccgcgatgagctcaccaagaaccaagttagcctgacatgtcttgtgaaagggttttatccttctgacatagcagtagagtgggaatcaaatggacagccagagaacaactacaagactaccccgcccgtcctggacagtgatggcagcttctttttgtactccaagctcacagtggacaaatctagatggcagcaaggcaatgttttctcgtgcagcgtgatgcacgaagctctgcataaccactatacccagaagtccttatcactgagtcctgggaaa

SEQ ID NO: 23196 - RNA, 657 nt, synthetic construct
  misc_feature 1..657: note = derived and/or modified sequence opt3 from Epratuzumab_LightChain
  source 1..657: mol_type = other RNA
gacatccagctgacccaaagcccctcctctctctcagccagtgtgggcgatagagtcacaatgagctgcaagtcctctcagtcggttctttactcagctaaccacaaaaattatctggcatggtaccagcagaagcctgggaaagccccaaagttgttaatttattgggcgagcactagggagagtggagtgccgtcccggttctctggtagcggctccgggacggactttaccttcacaatatcaagtctgcaacccgaagatatcgctacttactattgtcatcagtacctaagctcttggacctttggacagggcacaaaagtagagattaagcgcaccgtggccgcaccttccgtcttcatctttccaccctcagacgaacagctcaagagcggtactgccagtgtggtttgcctgcttaacaatttctatcctcgagaggctaaagtgcaatggaaggtcgataacgcactgcagtctggaaattcccaggaaagcgtgacagagcaggactcgaaagattctacctactccttgtcaagtacgctcactctgagcaaggccgactacgagaaacacaaggtatatgcttgtgaagttacccatcaagggctgtcctctccagtgacaaagagctttaaccgtggcgagtgc

SEQ ID NO: 23197 - RNA, 762 nt, synthetic construct
  misc_feature 1..762: note = derived and/or modified sequence opt3 from Eptacog_beta_HeavyChain1
  source 1..762: mol_type = other RNA
atcgtgggcgggaaggtctgccccaagggagagtgtccttggcaggttctgctccttgtgaacggtgcccaactgtgcggcgggaccttgattaatacaatatgggtagtgagcgctgcacactgtttcgacaagatcaaaaactggagaaatttaattgccgtcctgggagaacatgatctatccgagcacgacggcgatgaacagtctaggcgggtggcgcaggttatcattccatcaacttacgtgccgggtacgaccaaccatgacatcgctctcctgcgccttcaccagcccgtcgtgctgacagatcatgtagttcctttgtgcctcccagagcgaacttttagtgaacgtaccctggccttcgtgagatttagcctggtctccgggtggggacaactcttagacaggggcgcaacagccctggagcttatggtgttgaatgtgccccggctgatgacccaggattgtctacagcagtctcgcaaggtcggcgactcgcctaacataactgagtatatgttctgcgctgggtactcagatggaagcaaagacagttgtaagggtgattccggcgggccacacgcaacacactatagaggaacctggtacctcacgggcatcgtttcttggggtcaagggtgcgccactgtgggacattttggcgtatataccagggtgagccagtacattgaatggctgcagaaacttatgcggtccgagccccgccctggcgtcctgttgcgagctccattcccg

SEQ ID NO: 23198 - RNA, 456 nt, synthetic construct
  misc_feature 1..456: note = derived and/or modified sequence opt3 from Eptacog_beta_LightChain1
  source 1..456: mol_type = other RNA
gccaacgctttcctggaggaactcagacccggcagccttgagagggaatgcaaggaggaacagtgttcctttgaggaggcacgggaaatcttcaaagacgccgagcgcaccaagctgttttggatttcttactcagatggggaccaatgcgcgagtagcccttgtcagaatggaggttcctgcaaagatcagttgcagtcttatatatgtttctgcttaccagcttttgaaggccgaaactgtgagacacacaaggacgatcaactgatctgcgtgaatgagaacgggggatgtgaacagtactgctcggaccatactggcacgaaacgttcatgtagatgccacgagggttatagcctactcgccgatggggtcagttgcaccccgacagttgaatacccctgtggaaagattcctatcctggagaagaggaatgcatccaaaccacagggccgg

SEQ ID NO: 23199 - RNA, 708 nt, synthetic construct
  misc_feature 1..708: note = derived and/or modified sequence opt3 from Erlizuab_HeavyChain1
  source 1..708: mol_type = other RNA
gaggtgcagctggtcgaaagcggcgggggactcgttcaacccggtggctcccttagactgtcttgcgccacctcagggtacacattcactgagtatacgcactggaggcaggctcctggaaagggcttggaatgggtggcaggtatcaacccgaaaaatgggggaaccagtcataaccagcggtttgaccgcttcacaattagcgtagataagtccacttctaccgcctaccaaaattcgttacgagcggaggacacagctgtgtattactgtgcccgttggagaggcctgaactatggctttgatgtcaggtacttcgacgtgtgggggcagggaaccctagttactgtgtcaagcgcaagtacaaaaggtccatccgtctttcccctcgccccttctagcaagtccacctcaggcgggacggctgcactgggatgccttgtgaaagattatttcccagaacccgtaactgttagttggaatagcggcgccctgacctctggtgtgcacacatttcctgctgtcttgcagtcctcagggctctacagcctgagttctgtggtgactgtcccatccagctcgctgggaacccagacatacatatgtaacgttaatcataagccctctaacaccaaggtggacaaaaaggtagagcctaaatcctgcgataagacgcacacttgtccaccgtgccccgcccctgagctc

SEQ ID NO: 23200 - RNA, 639 nt, synthetic construct
  misc_feature 1..639: note = derived and/or modified sequence opt3 from Erlizuab_LightChain1
  source 1..639: mol_type = other RNA
gacatccagacccaaagcccctcctctctgtcagccagtgtgggcgatagagtcacaattacttgcagggctagccaggacataaacaattacctcaactggtatcagcagaagcctgggaaagcaccaaaacttctgatctactatacgtccaccttgcactctggagttccgtcgcggttctcaggtagcggcagtgggacagattacactttaaccatttcctctctgcaacccgaggactttgccacatattactgtcagcagggaaataccctacctccaactttcggccagggtacaaaggtggaaatcaagcgcaccgtagcggctcccagcgtgtttattttccctccatccgatgagcaactcaaatcagggacggccagtgtcgtgtgcctgcttaacaatttttatccccgagaagcaaaggttcagtggaaggtggacaacgccctgcagagcggaaattctcaggagtccgtcactgaacaagattcaaaagacagcacctacagtttgtcttccacactcactctgagcaaggctgattacgagaaacataaggtgtatgcatgtgaggtaacccaccagggcctgtcgtctcctgttacaaaatccttcaaccgtggcgaatgc

SEQ ID NO: 23201 - RNA, 1341 nt, synthetic construct
  misc_feature 1..1341: note = derived and/or modified sequence opt3 from Etaracizumab_HeavyChain1
  source 1..1341: mol_type = other RNA
caggtgcaactggtcgagagcggcgggggagttgtgcagcccggtagatccctcaggctttcttgcgccgcttcaggcttcacctttagtagctacgacatgtcctgggtacggcaggcacctgggaagggactggaatgggtggccaaagtctcttcgggcggtgggtcaacatattacttggatactgtgcagggacgcttcacgatcagccgagacaacagtaagaataccttatatctgcaaatgaactccctacgtgcggaggatacagctgtttactattgtgccagacacctccatggctcttttgcaagctggggccaggggactaccgtgacagtctcctcagccagtaccaaaggaccaagcgtgttcccgctggctccctcttccaagtcaactagcggtggcacagcagcccttgggtgcctggtaaaagactactttcctgaaccagttaccgtgagttggaactctggagctttgacgtccggcgtccacactttccccgccgtgctccagagctcgggtctgtattctctgtcctcagtggtcaccgttcctagtagctccctcgggacacagacttacatttgtaatgtgaatcataagccatctaacaccaaggtagataaaagggtggagcccaagagctgcgacaaaacacacacctgtcctccatgcccggcgcccgaattactgggaggcccttcagtctttcttttcccacccaagcctaaagatacgttgatgataagtcggactccagaggtgacatgtgttgtggtcgacgtgtcccatgaggatcccgaagtaaagtttaattggtacgttgacggcgtggaggtccacaacgcaaagaccaaaccgcgcgaggaacaatataatagcacttacagagtggtctctgtgctgacagttctacaccaggattggctcaacgggaaggagtataaatgcaaggtgtcaaataaagccctgcctgctcccatcgaaaagaccattagtaaagccaagggacagccaagggagcctcaggtatacacgcttcccccaagccgggaagagatgaccaagaaccaagtctccctgacatgtttggtgaaaggtttctatccctctgacatcgcagttgaatgggagtcgaatggccagcctgagaacaattacaagactaccccaccggtgctcgatagcgacgggtcctttttcctgtattcaaaattaacagtcgacaagagtcgctggcagcaaggaaacgtgttttcttgcagcgtaatgcatgaagctctgcacaaccattacactcagaaatccctctcacttagccccggcaag

SEQ ID NO: 23202 - RNA, 642 nt, synthetic construct
  misc_feature 1..642: note = derived and/or modified sequence opt3 from Etaracizumab_LightChain1
  source 1..642: mol_type = other RNA
gagatcgtgctgacccagagccccgccacactctccctttctcctggcgaaagagctactctgtcatgccaagcaagtcagagcatttccaacttcttgcactggtaccagcagaggccagggcaagccccgcggttactgatacgctatcgatctcagtcgatctcagggattcccgcgcgttttagcggtagtggctccgggacggacttcaccctaacaatctctagcctcgagcctgaagattttgctgtctactattgtcagcagtccggatcatggccactgactttcggcggtgggaccaaggttgagattaaaagaacagtggccgcacccagtgtatttatcttccctccaagcgacgaacaacttaagtctggaaccgcctccgtggtctgcctgttgaataacttttaccccagggaggctaaagtgcagtggaaggttgataatgcactccagtcaggcaacagccaggagagtgtgactgaacaagactctaaagattccacatatagcctgtcgtctaccctgacgctctccaaggccgactacgagaagcataaagtctatgcttgtgaagtgactcaccagggcttatcaagtcctgtaaccaagagcttcaatcggggagagtgc

SEQ ID NO: 23203 - RNA, 1326 nt, synthetic construct
  misc_feature 1..1326: note = derived and/or modified sequence opt3 from Etrolizuab_HeavyChain1
  source 1..1326: mol_type = other RNA
gaggtgcagctggtcgaaagcggcgggggactcgttcaacccggtggctcccttagactgtcttgcgccgcttcagggttctttatcaccaacaattactggggatgggtgaggcaggcacctggcaagggtttggagtgggtagggtatattagttacagcggatccacatcttataacccatcgttaaaatcacggttcactataagccgcgacacgagtaagaataccttttacctgcagaactccctacgagccgaagatacagcggtgtattactgtgctcgtactggctctagcggctatttcgacttttgggggcagggaaccctcgtcacagtgtcctcagccagtaccaaaggtccgagcgttttccccctggcaccttcttccaagtcaactagcggcgggacagccgctcttggatgcctggtgaaagattactttccagagcccgtcaccgtgagttggaactctggcgcattgacgtccggtgtacacactttccctgccgttctccaaagctcggggctgtactctctgtcctcagtggtcaccgtgccaagtagctccctcggaacacagacttatatctgtaatgtgaatcataagccctctaacaccaaggtcgacaaaaaggttgaacctaaaagctgcgataagacacacacctgtccaccgtgccccgctcctgagttactgggcggcccatcagtgtttctttttccccctaaaccaaaggacacgttgattagtagaactcccgaggtaacatgtgtggtcgtggatgtttcccatgaagacccggaggtgaagttcaattggtacgtcgatggggtggaagtacacaacgccaaaaccaagcctagggaggagcagtataatagcacttaccgggttgtgtctgtcctgacagtgctacatcaggactggctcaacggaaaagaatataagtgcaaagtctcaaataaggcgctgcccgcaccaatcgagaaaaccattagtaaggccaagggtcaacctcgcgaaccccaggtgtacacgcttccacccagcagagaggaaaccaaaaaccaggtttccctgacatgtttggtgaagggcttctatccttctgatatcgctgtagagtgggagtcgaatgggcagccagaaaacaactacaaaactaccccgcccgtcctcgacagcgatggatcctttttcctgtactcaaagttaacagtggacaaaagtaggtggcaacagggcaatgttttctcttgcagcgtgcacgaggccctgcacaaccattatactcagaagtccctctcacttagccctggt

SEQ ID NO: 23204 - RNA, 1326 nt, synthetic construct
  misc_feature 1..1326: note = derived and/or modified sequence opt3 from Etrolizuab_HeavyChain2
  source 1..1326: mol_type = other RNA
gaggtgcagctggtcgaaagcggcgggggactcgttcaacccggtggctcccttagactgtcttgcgccgcttcagggttctttatcaccaacaattactggggatgggtgaggcaggcacctggcaagggtttggagtgggtagggtatattagttacagcggatccacatcttataacccatcgaaattatcacggttcactataagccgcgacacgagtaagaataccttttacctgcagaactccctacgagccgaagatacagcggtgtattactgtgctcgtactggctctagcggctatttcgacttttgggggcagggaaccctcgtcacagtgtcctcagccagtaccaaaggtccgagcgttttccccctggcaccttcttccaagtcaactagcggcgggacagccgctcttggatgcctggtgaaagattactttccagagcccgtcaccgtgagttggaactctggcgcattgacgtccggtgtacacactttccctgccgttctccaaagctcggggctgtactctctgtcctcagtggtcaccgtgccaagtagctccctcggaacacagacttatatctgtaatgtgaatcataagccctctaacaccaaggtcgacaaaaaggttgaacctaaaagctgcgataagacacacacctgtccaccgtgccccgctcctgagttactgggcggcccatcagtgtttctttttccccctaaaccaaaggacacgttgattagtagaactcccgaggtaacatgtgtggtcgtggatgtttcccatgaagacccggaggtgaagttcaattggtacgtcgatggggtggaagtacacaacgccaaaaccaagcctagggaggagcagtataatagcacttaccgggttgtgtctgtcctgacagtgctacatcaggactggctcaacggaaaagaatataagtgcaaagtctcaaataaggcgctgcccgcaccaatcgagaaaaccattagtaaggccaagggtcaacctcgcgaaccccaggtgtacacgcttccacccagcagagaggaaaccaaaaaccaggtttccctgacatgtttggtgaagggcttctatccttctgatatcgctgtagagtgggagtcgaatgggcagccagaaaacaactacaaaactaccccgcccgtcctcgacagcgatggatcctttttcctgtactcaaagttaacagtggacaaaagtaggtggcaacagggcaatgttttctcttgcagcgtgcacgaggccctgcacaaccattatactcagaagtccctctcacttagccctggt

SEQ ID NO: 23205 - RNA, 639 nt, synthetic construct
  misc_feature 1..639: note = derived and/or modified sequence opt3 from Etrolizuab_LightChain1
  source 1..639: mol_type = other RNA
gacatccagacccaaagcccctcctctctgtcagccagtgtgggcgatagagtcacaattacttgcagggctagcgagtccgttgacgatctccttcactggtaccagcagaagcctgggaaagcaccaaagctgttgataaaatatgcctctcagtcgatctcaggagtgccgagccggttcagtggttccggctctgggacggactttaccttaacaattagctccctgcaacccgaagatttcgcgacttactattgtcagcagggaaactcactacctaatacctttggccagggtacaaaggtagagatcaaacgcaccgtggctgccccaagtgtcttcatttttccccctagcgacgaacaactcaagtctgggactgcatccgtggtttgcctgcttaacaatttctacccacgagaggccaaggtgcagtggaaagtcgataacgctctgcagtcaggaaatagccaggaaagtgtgacagagcaagactctaaggattccacctatagcttgtcgtctacgctcactctgtccaaagcagactacgagaagcataaagtatatgcctgtgaagttacccaccagggcctgtcaagtcccgtgacaaagagctttaaccgtggcgagtgc

SEQ ID NO: 23206 - RNA, 1338 nt, synthetic construct
  misc_feature 1..1338: note = derived and/or modified sequence opt3 from Etrolizumab_HeavyChain1
  source 1..1338: mol_type = other RNA
gaggtgcagctggtcgaaagcggcgggggactcgttcaacccggtggctcccttagactgtcttgcgccgcttcagggttctttatcaccaacaattactggggatgggtgaggcaggcacctggcaagggtttggagtgggtagggtatattagttacagcggatccacatcttataacccatcgttaaaatcacggttcactataagccgcgacacgagtaagaataccttttacctgcagatgaactccctacgagccgaagatacagcggtgtattactgtgctcgtactggctctagcggctatttcgacttttgggggcagggaaccctcgtcacagtgtcctcagccagtaccaaaggtccgagcgttttccccctggcaccttcttccaagtcaactagcggcgggacagccgctcttggatgcctggtgaaagattactttccagagcccgtcaccgtgagttggaactctggcgcattgacgtccggtgtacacactttccctgccgttctccaaagctcggggctgtactctctgtcctcagtggtcaccgtgccaagtagctccctcggaacacagacttatatctgtaatgtgaatcataagccctctaacaccaaggtcgacaaaaaggttgaacctaaaagctgcgataagacacacacctgtccaccgtgccccgctcctgagttactgggcggcccatcagtgtttctttttccccctaaaccaaaggacacgttgatgattagtagaactcccgaggtaacatgtgtggtcgtggatgtttcccatgaagacccggaggtgaagttcaattggtacgtcgatggggtggaagtacacaacgccaaaaccaagcctagggaggagcagtataatagcacttaccgggttgtgtctgtcctgacagtgctacatcaggactggctcaacggaaaagaatataagtgcaaagtctcaaataaggcgctgcccgcaccaatcgagaaaaccattagtaaggccaagggtcaacctcgcgaaccccaggtgtacacgcttccacccagcagagaggaaatgaccaaaaaccaggtttccctgacatgtttggtgaagggcttctatccttctgatatcgctgtagagtgggagtcgaatgggcagccagaaaacaactacaaaactaccccgcccgtcctcgacagcgatggatcctttttcctgtactcaaagttaacagtggacaaaagtaggtggcaacagggcaatgttttctcttgcagcgtgatgcacgaggccctgcacaaccattatactcagaagtccctctcacttagccctggt

SEQ ID NO: 23207 - RNA, 642 nt, synthetic construct
  misc_feature 1..642: note = derived and/or modified sequence opt3 from Etrolizumab_LightChain1
  source 1..642: mol_type = other RNA
gacatccagatgacccaaagcccctcctctctgtcagccagtgtgggcgatagagtcacaattacttgcagggctagcgagtccgttgacgatctccttcactggtaccagcagaagcctgggaaagcaccaaagctgttgataaaatatgcctctcagtcgatctcaggagtgccgagccggttcagtggttccggctctgggacggactttaccttaacaattagctccctgcaacccgaagatttcgcgacttactattgtcagcagggaaactcactacctaatacctttggccagggtacaaaggtagagatcaaacgcaccgtggctgccccaagtgtcttcatttttccccctagcgacgaacaactcaagtctgggactgcatccgtggtttgcctgcttaacaatttctacccacgagaggccaaggtgcagtggaaagtcgataacgctctgcagtcaggaaatagccaggaaagtgtgacagagcaagactctaaggattccacctatagcttgtcgtctacgctcactctgtccaaagcagactacgagaagcataaagtatatgcctgtgaagttacccaccagggcctgtcaagtcccgtgacaaagagctttaaccgtggcgagtgc

SEQ ID NO: 23208 - RNA, 1359 nt, synthetic construct
  misc_feature 1..1359: note = derived and/or modified sequence opt3 from Evinacumab_HeavyChain1
  source 1..1359: mol_type = other RNA
gaggtgcagctggtcgaaagcggcgggggagttatccaacccggtggctccctcagactttcttgcgccgcttcagggttcacctttgacgattacgcaatgaactgggtgaggcagggacctggcaagggtctggagtgggtaagtgccattagcggggacggaggctccacatattacgcggattctgtgaaaggccggttcactatatcgcgcgacaattcaaagaacagcttgtatttacagatgaatagtctgcgagctgaagatacggcctttttctactgtgcaaaagacctacgtaacaccatctttggggtcgtgattccagatgccttcgacatctggggacagggtacaatggttactgtgtcctctgctagcaccaagggcccgtccgtctttcccctcgcaccttgctcaagaagtacaagcgagtctaccgccgctctggggtgtcttgtgaaagattatttcccagaacccgtaactgtttcctggaatagcggagccctgacaagcggcgtgcacacctttcctgcggtcttgcaaagttctggtctctactccctgagctcggtggtgacggtcccatcttcctcactggggactaagacctatacatgcaacgttgaccataagcccagtaatactaaagtggataagagggtagagagcaaatacggacctccatgtccgccctgccctgcaccagagttcctcggcggcccctccgtgtttttattccctccaaagcccaaagacaccctgatgatttctcggacaccggaagtcacctgtgtggttgtggatgtcagccaggaggaccctgaagtgcagtttaactggtacgtagacggggttgaggtgcacaatgccaagacgaagccccgcgaggaacagttcaactcaacttatagagtcgtgagtgtccttacagtgttgcatcaagattggctgaatggaaaagagtacaagtgcaaagtttccaacaagggtctaccaagctctatcgagaaaaccatatcaaaggctaaaggccagcctagggaaccccaggtgtatactctcccacccagtcaggaagagatgacaaagaatcaagtaagcctgacctgtcttgtcaaggggttctacccttccgacatcgccgtggagtgggaatctaacggacagccagagaataactataaaacgaccccgcccgttctggattcggacggcagctttttcttgtactcccggctcacagtggataagtcacgctggcaggaaggtaacgtctttagttgctctgtgatgcacgaggcactgcataatcactatactcaaaaatcattatccctgtcactcgggaag

SEQ ID NO: 23209 - RNA, 642 nt, synthetic construct
  misc_feature 1..642: note = derived and/or modified sequence opt3 from Evinacumab_LightChain1
  source 1..642: mol_type = other RNA
gacatccagatgacccaaagcccctccacactgtctgcctcagtgggcgatagagtcactattacgtgcagggctagtcagagcatacggtcctggctcgcatggtaccagcagaagcctgggaaagccccaaaacttctgatctataaggcgtcttcgttggagtcaggagttccgagccgcttcagtggttccggctctgggaccgaatttacattaactattagctccctgcaacccgacgatttcgctacctactattgtcagcagtacaactcatatagttacacatttggacagggcaccaagctagagatcaaacgaactgtggccgcacctagcgtattcatttttccaccctctgacgaacaactcaagtccggtacagcctcagtggtctgcctgcttaataacttctatcctcgtgaggctaaggtgcagtggaaagttgataatgcactgcagagcgggaacagtcaggaatctgtgaccgagcaagactccaaggatagcacgtactcgttgtcttccactctcaccctgtcaaaagccgactacgagaagcacaaagtctatgcttgtgaagtgacacatcagggactgagtagcccagtaactaagtcctttaatagaggcgagtgc

SEQ ID NO: 23210 - RNA, 1323 nt, synthetic construct
  misc_feature 1..1323: note = derived and/or modified sequence opt3 from Evolocumab_HeavyChain1
  source 1..1323: mol_type = other RNA
gaggtgcagctggtccaaagcggcgccgaagttaagaaacccggggcttccgtgaaggtatcttgcaaagcatcaggatacaccctcacaagttatggtatcagctgggtgagacaggcccctggccaggggcttgagtggatgggatgggtctccttctacaacggcaatactaactatgcgcagaagctgcaaggtagggggacgatgaccacagacccatctacttcgaccgcttacatggaattgcggtcattacgcagcgatgacacagccgtgtattactgtgcacgaggatatggcatggatgtttggggccaggggaccactgtgacagtcagttccgcctctaccaaaggaccgagcgtgtttcccctggctccttgctcccgttcaacgagtgagagcactgcagccctaggttgtctcgtaaaggactacttcccagaacccgttaccgtgtcttggaactccggcgctctgacatcaggggtccacacttttcctgccgtgcttcagagcagtggactgtactctttgtccagcgtggtcaccgttccatcgtctaatttcggcacacagacctatacgtgcaatgtggatcataagccctccaacactaaagtagacaagacagtggagagaaaatgttgcgtcgagtgtcctccatgcccggcgccccctgtggcaggtccatcagtttttctctttccccctaagccaaaagataccctgatgattagtaggactcccgaagtgacatgtgtcgtggtagacgttagccacgaggatccggaagtgcaatttaattggtacgtcgacggggtggaggtccataacgccaagaccaagcctcgggaggaacagttcaattccacgtttcgcgtggtttctgtgctgaccgtagtccaccaggattggctcaacggaaaagagtataagtgcaaagtgagcaataagggcttacccgctccaatagaaaagacaatctcaaagactaaaggccagcctagagagccccaagtttacaccctgccacccagtagggaagagatgacaaagaaccaggtgtcccttacttgtttggtcaaggggttctatcctagcgacattgccgtggagtgggaatctaatggacagccagagaacaattacaaaaccacaccgcccatgctggattcagacggtagtttcttcctatatagcaagctcaccgtagacaaatcccggtggcaacagggcaacgtgttttcttgctcggttatgcatgaagcactgcacaaccactacactcagaaaagcctttccctgtcacctgggaaa

SEQ ID NO: 23211 - RNA, 645 nt, synthetic construct
  misc_feature 1..645: note = derived and/or modified sequence opt3 from Evolocumab_LightChain1
  source 1..645: mol_type = other RNA
gagagcgccctgacccagcccgcttccgtgtctggctcacctgggcaaagtatcacaattagctgcactggaacgtcctctgacgtcggtggctacaactcggtttcatggtatcagcagcacccagggaaggcaccgaaactcatgatatacgaagtgagcaatagacccagtggagtatccaacaggttctctggcagcaagtccggtaataccgcctcacttacaatcagtgggctgcaggcggaggatgaagctgactattactgtaacagctatacttctacctccatggtgtttggaggcggcacaaaattgaccgtcttagggcaacctaaggccgcaccatcagtgactctgtttccccctagcagtgaggaactacaggccaataaagctacactcgtttgcctgatttctgatttctacccaggagcagtgaccgtcgcctggaaggctgactccagccccgtgaaggccggtgtagagacgactaccccttcgaaacagtctaacaataagtatgcggcatcctcataccttagtctgacaccagagcagtggaaaagccatcggtcctactcttgtcaagttactcacgaaggcagcaccgtggagaagacagtcgccccgaccgaatgctca

SEQ ID NO: 23212 - RNA, 1353 nt, synthetic construct
  misc_feature 1..1353: note = derived and/or modified sequence opt3 from Exbivirumab_HeavyChain1
  source 1..1353: mol_type = other RNA
caggtgcaactggtcgagagcggcgggggagttgtgcagcccggtggctccctcagactttcttgcgccccttcagggttcgtatttaggagttacggaatgcactgggtgcggcagaccccaggcaagggtctggaatgggtcagcttgatctggcatgacgggtccaaccgcttctatgctgattctgtgaaaggacgatttacaatttcgcgtgacaattcaaagaacactttatacctgcagatgaatagcctaagagcagaggatacggccatgtatttctgtgcgagggaacggctcatagctgccccggcagcctttgacctgtggggccaaggcacccttgttacagtgagttccgcttctactaaagggcccagcgtcttccctctggcaccatcctcaaagagtaccagcggaggtacagccgctttgggctgcctcgtgaaagattactttcccgagcctgtaaccgtttcttggaactccggggccctgacttcaggagtgcacacattcccagcggtcctgcagagcagtggcctctattctttatccagcgtggtgaccgtcccctcgtcttccctgggtacgcagacttacatctgtaatgttaaccataagccttcaaataccaaggtggacaaacgcgtagaaccaaagagttgcgataaaacacacacttgtccgccctgccctgcaccagagcttttgggagggcccagcgtgtttctgttccctccaaagcccaaagacaccctaatgatttccagaacaccggaggtcacctgtgtggttgtggatgtctctcatgaagaccctgaggtgaagtttaactggtatgtagatggcgttgaagtgcacaatgccaagacgaaacccagggaggagcagtacaacagcacttaccgggtcgtgtcagtcctcacagtgctgcaccaagactggcttaatggcaaggaatataaatgcaaggttagtaacaaagctctgccagcccctatcgagaagaccatttccaaagcaaaggggcagccccgcgaaccacaggtgtacactttgccccctagccgagaggaaatgacaaagaatcaggtatctctcacctgtctggtcaaaggattctatccatcagatatcgctgtggagtgggagagtaacggtcaaccggaaaataactacaagacgacaccccctgttttagacagcgacggctcctttttcctgtattctaaactcaccgtggataagtcgagatggcagcaggggaacgtcttcagctgctccgtgatgcatgaggcccttcacaatcattacactcaaaaatcactgagtttgtctccaggaaag

SEQ ID NO: 23213 - RNA, 642 nt, synthetic construct
  misc_feature 1..642: note = derived and/or modified sequence opt3 from Exbivirumab_LightChain1
  source 1..642: mol_type = other RNA
agctacgtgctgacccagcccccttccgtctctgttgccccaggcaagacagctagaatctcatgcgggggaaacaatattggtactaaaaacgtgcactggtatcaacagaagccgggccaggcacccgtactcgtggtctacgccgacagtgataggcctagcgggataccagagcggttctccggatctaattcgggcaacacggcgacccttacaatctcacgcgtggaagctggtgacgaggccgattattactgtcaggtttgggacagcgtgagttatcatgtcgtgtttgggggaggcactaccctgacagtattgggccaacccaaagcagccccttccgttaccttattcccaccctctagcgaagaactgcaggctaataaggcaactctagtgtgcctcatttccgatttttaccctggggccgtcacagtggcttggaaagccgactcaagtccagtgaaggcgggagtcgaaaccacgactccgagcaagcagtctaacaataaatatgcagcctcctcatacctgagccttacccccgagcagtggaagagtcaccgatcttactcctgtcaagttacacatgagggtagcactgtggagaaaaccgtagctcctacagagtgctcg

SEQ ID NO: 23214 - RNA, 1347 nt, synthetic construct
  misc_feature 1..1347: note = derived and/or modified sequence opt3 from Farletuzumab_HeavyChain1
  source 1..1347: mol_type = other RNA
gaggtgcagctggtcgaaagcggcgggggagttgtgcaacccggtagatccctcaggctttcttgctcagccagtggcttcacctttagcgggtacggactgtcctgggtacggcaggctcctggcaagggtttggagtgggtggcaatgatctcttcagggggatcgtatacatactatgccgacagcgtcaaaggccgcttcgcgattagtcgagataacgctaagaatactttatttctgcagatggactccctacgtccagaagatacgggcgtgtacttctgtgccagacacggggacgatccggcatggtttgcctattggggacagggtacccccgttacagtgtctagcgcttccactaaaggcccttcagtcttcccactcgcacccagtagcaagtctacctccgggggaacagccgctctgggctgccttgtgaaagactactttcctgagccagtaaccgtttcatggaacagcggtgccctgacaagtggggtgcatacattccccgcggtcttgcaatcttccggactctatagcctgtcgtctgtggtgaccgtcccttcctcaagtctgggcacgcagacttacatatgtaatgttaaccacaagccaagcaataccaaggtggataaaaaggtagaaccgaaatcctgcgacaagacacatacttgtcccccttgcccagcacccgagctcttaggcgggccttctgtgtttctgttcccacccaaaccgaaggatacccttatgatcagcaggacacctgaggtcacctgtgtggttgtggacgtctcacacgaagatcccgaggtgaagtttaactggtacgtagacggagttgaagtgcataatgccaaaacgaagccacgggaggagcagtataacagtacttaccgcgtcgtgtccgtcttgacagtgctgcaccaggattggctaaatggtaaagaatataagtgcaaagttagcaacaaggctctccctgcccccattgagaaaaccatctctaaggcaaagggccaaccaagagaaccccaggtgtacactctgcctccatcaagggacgagcttactaaaaatcaggtaagtctgacctgtttggtcaaggggttctatccgagcgacattgctgtggaatgggagtccaacggacagcccgagaataactacaaaacgacccctccagttctcgattctgacggctcgtttttcctgtatagcaagttaacagtggataaatcccggtggcaacagggtaatgtcttctcatgcagtgtgatgcacgaagccctgcataaccactacactcagaagtctctcagcctttcccccgggaag

SEQ ID NO: 23215 - RNA, 651 nt, synthetic construct
  misc_feature 1..651: note = derived and/or modified sequence opt3 from Farletuzumab_LightChain1
  source 1..651: mol_type = other RNA
gacatccagctgacccaaagcccctcctctctctcagccagtgtgggcgatagagtcacaattacttgcagcgtttcctcttcgatatcaagcaacaatcttcactggtaccagcagaagcctgggaaagctccaaagccgtggatctatggaacgagtaacctggcatccggtgtgccctctaggttcagcggctccgggtcaggaaccgactacacatttactattagtagcttgcagcctgaggatatcgccacctattactgtcaacagtggtcttcctatccatacatgtatacattcggccagggtaccaaagtagaaattaagcggactgtggcggctccctcagtctttatcttccctccaagcgacgagcagttaaaaagtgggacagcctctgtggtttgcctgctaaataacttttacccccgcgaagcaaaggtgcaatggaaggtcgataatgccctccagtccggaaacagccaggagtcggtgaccgaacaggactctaaagattccacgtactcactgagtagcactcttaccctgtccaaggctgactatgagaaacataaggtatacgcatgtgaggttacacaccaaggcttgtctagccctgtgactaaatcattcaatcgaggcgaatgc

SEQ ID NO: 23216 - RNA, 1338 nt, synthetic construct
  misc_feature 1..1338: note = derived and/or modified sequence opt3 from Fasinumab_HeavyChain1
  source 1..1338: mol_type = other RNA
caggtgcaactggtccagagcggcgccgaggttaagaaacccggggcttccgtgaaggtatcttgcaaagtgtcaggattcaccctcacagaacttagtatccactgggtcagacaggcacctggtaagggcctggagtggatgggagggtttgacccagaagatggcgagactatttacgcccagaaattccaaggtagggtgacgatgaccgaagacacaagcactgataccgcgtatatggagttgacatccttacggtctgaggacaccgctgtttactattgttcgactatatttggggtggtcacaaacttcgataattggggacagggcaccctggtgacggtatcaagcgccagtactaagggcccgtccgtttttcccctagcaccttgctctcgcagcacctccgaatcaacagccgctctcgggtgtctggtgaaggactacttcccagagcccgtcactgtgagttggaacagcggagcacttacctctggtgtgcatacatttcctgccgtcctgcagtcctcaggcttgtatagcctcagttctgttgtgaccgtaccatccagctcgctggggacgaaaacttacacatgcaatgtggatcacaagccctctaacaccaaagtcgacaagcgagtggaatccaaatatggacctccatgtccgccctgccctgctccagagttcctgggcggtccctcagtttttctcttccctccaaagcccaaggatactttaatgatcagtcgtacaccggaggtgacctgtgtcgtggtagacgttagccaggaagatcctgaggtgcaatttaattggtacgtcgacggggtggaagtccataacgccaaaacgaagcccagagaggaacagttcaattccacctacagggtggtttctgtgctgacagtacttcaccaggattggttgaacggaaaagagtataagtgcaaagtcagcaataagggcctgccatcaagtattgagaaaactatctccaaggcgaagggccagcctcgggaaccccaagtgtacaccctaccacccagccaggaggaaatgactaaaaaccaggtttctctcacatgtctggtgaaggggttttatccttcagacattgcagtcgagtgggaaagtaatggacaaccagagaacaattacaaaaccacaccgcccgtgcttgacagcgatggttccttcttcctgtattctcgcttgaccgtagacaagtcgagatggcaggagggcaacgtgtttagctgctccgttatgcatgaagccctccacaatcactacactcagaaatcactgagtttatctctggggaag

SEQ ID NO: 23217 - RNA, 642 nt, synthetic construct
  misc_feature 1..642: note = derived and/or modified sequence opt3 from Fasinumab_LightChain1
  source 1..642: mol_type = other RNA
gacatccagatgacccaaagcccctcctctctgtcagccagtgctggcgatagagtgacaattacttgcagggcaagccaggccatacggaacgacctcgggtggtaccagcagaagcctggaaaagcgccaaagcgccttatctatgctgccttcaatctgcaatccggtgtcccgtctcgattttcgggctcagggagcggaacggagttcaccttgacaattagttccttacagcccgaagatctggcatcttactattgtcagcagtacaaccgttatccttggacttttggccaaggtaccaaagttgagatcaagagaacagtggccgctccaagcgtattcatttttcccccttccgacgaacagctaaaatcagggaccgcaagtgtggtctgcctcctgaataacttctacccaagggaggccaaggtgcagtggaaggttgataatgcccttcagagcggaaactctcaagaatccgtgactgagcaggactcaaaagatagcacatatagtctgtcttccaccttgacgctcagcaaggctgactacgagaaacacaaggtctacgcgtgtgaagtgactcatcagggcctgtcgtctcccgtaaccaaatcctttaatcggggcgagtgc

SEQ ID NO: 23218 - RNA, 1350 nt, synthetic construct
  misc_feature 1..1350: note = derived and/or modified sequence opt3 from Fezakinumab_HeavyChain1
  source 1..1350: mol_type = other RNA
caggtgcaactggtccagagcggcgccgaggttaagaaacccggggcttccgtgaaggtatcttgcaaagcatcaggatacaccttcacaaactattacatgcactgggtgagacaggcccctggtcagggcctcgaatgggtcgggtggatcaatccatatactggaagtgcgttttacgctcaaaagttcaggggccgggtgacgatgacccgcgacacaagcatttccactgcctatatggagctttctcgactgcgttcggatgacaccgcagtttactattgtgccagagaaccggagaaatttgattcagacgatagcgacgtgtggggtagggggacattggtcaccgtgagttccgcttctactaagggacccagcgtattccctttagcaccatcctcaaagagtacaagcggcggcaccgccgctctggggtgcctagttaaagattactttcccgaacctgtgacggtctcttggaactccggagccctcacttcaggtgtgcataccttcccagcggtgctgcagagcagtggcctttactctctgtccagcgtcgttacagtgccctcgtcttccttggggactcagacctatatatgtaatgtaaaccacaagccttcaaatacaaaagtggacaagaaagtcgagccaaagagttgcgataagacccatacgtgtccgccctgccctgcaccagagctcctgggaggccccagcgtgtttctgttccctccaaaacccaaggacactctcatgatctcccggacaccggaagttacctgtgtggtcgtggatgtatctcacgaggaccctgaagttaaatttaactggtacgtggatggtgtcgaggtgcataatgccaagactaaaccccgcgaggaacagtataacagcacatacagagtcgtgtcagttttaaccgtgctgcaccaagactggcttaatgggaaggagtataaatgcaaggtaagtaacaaggctttgccagcccctattgagaaaacgatctccaaggcaaaaggacagcccagggaaccacaggtctacaccctgccccctagccgggaagagatgacaaagaatcaggtgtctctaacttgtctcgttaaaggcttctatccatcagacattgctgtggagtgggaaagtaacggccaaccggagaataactacaagaccacaccccctgtcctggatagcgacgggtcctttttcctttactctaagctgactgtggataaatcgcgctggcagcagggaaatgtatttagctgctccgtgatgcacgaagccttgcataaccactatacccaaaagtcactcagtctgtctccaggt

SEQ ID NO: 23219 - RNA, 651 nt, synthetic construct
  misc_feature 1..651: note = derived and/or modified sequence opt3 from Fezakinumab_LightChain1
  source 1..651: mol_type = other RNA
caggccgtgctgacccaaccccctagcgtctccggcgctccagggcagagagttacaatctcttgcactggatcaagtagcaacattggtgcaggctacggggtgcactggtatcagcagctcccgggaacggcccccaaacttctgatatacggcgactccaataggccttctggtgtaccagatcggttctcggggtcaaagagcggaaccagtgcgtccttggctatcacaggcttacaagccgaggacgaagcagattattactgtcagtcttatgacaacagcctgtccggctacgtgtttgggggaggtactcagctaaccgtcctcggccagcccaaggccgctccttcagtgacactgttcccacccagtagcgaggaacttcaagcaaataaagccaccctggtttgcttgatttctgatttttatcctggggctgtgactgtcgcctggaaggcggactcctcaccagtgaaagcaggagtagagacaaccacgccgagcaagcagagtaacaataagtacgccgcttcttcctacctcagcctgactcccgaacagtggaaatcgcatcgctcttattcctgtcaggttacccacgagggctcaacagtggagaagactgtcgcccctaccgaatgcagt

SEQ ID NO: 23220 - RNA, 1347 nt, synthetic construct
  misc_feature 1..1347: note = derived and/or modified sequence opt3 from FG-3019_HeavyChain1
  source 1..1347: mol_type = other RNA
gagggccagctggtgcaaagcgggggaggtctcgtccaccccggcgggtcccttagactgtcttgcgccggatcaggcttcacctttagtagctacggtatgcattgggttaggcaggctcctgggaagggattggaatgggtgtccggcatcggcacagggggaggtacttattctacggactcggtaaaaggccggttcaccatttcacgcgataacgcaaagaatagcttatacctgcagatgaacagtctacgagccgaggacatggcggtgtattactgtgctcgtggggattattacggatccggcagctttttcgactgctggggtcaggggacactcgtcactgtgtcttccgcctcaaccaaaggaccaagtgtttttccgctggcacccagctctaagtccacatcaggcggcaccgccgctcttgggtgtctggtgaaagattatttccctgaaccagtcactgtgagctggaatagtggagcattgacatctggtgtacacacctttcccgccgttctccaatccagcggcctgtactcgctgtcttccgtggtcacggtgccttcaagtagcctcgggactcagacctacatatgcaacgtgaatcataagccatccaacacaaaggtcgacaaaagagttgagcccaagtcttgtgataaaactcatacctgccctccatgtccggctcccgaattactgggaggccctagcgtgttcctttttccacccaagcctaaagacacattgatgatctcaaggaccccagaggtaacgtgcgtggtcgtggatgttagtcacgaggaccccgaagtgaagttcaattggtatgtcgatggtgtggaggtacacaacgccaagactaaaccgcgggaggaacagtacaattccacatatcgcgttgtgagcgtcctgaccgtgctacaccaggactggctcaacgggaaggagtacaaatgtaaggtctctaataaagcgctgcctgcacccattgaaaagactatctcaaaagccaagggccaaccaagagagcctcaggtgtatacacttcccccaagtagggaagagatgaccaagaaccaggttagcctgacgtgcttggtgaaaggattttacccctccgatattgctgtagaatgggagtctaatggccagcctgagaacaattataagaccacaccaccggtcctcgactcggacgggagcttctttctgtactccaaattaactgtggataagtcacggtggcaacagggaaacgttttcagttgttctgtgatgcatgaagccctgcacaaccattacacccagaaaagcctctccctttcacccggt

SEQ ID NO: 23221 - RNA, 642 nt, synthetic construct
  misc_feature 1..642: note = derived and/or modified sequence opt3 from FG-3019_LightChain1
  source 1..642: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatcctccaacctttggacaaggcacaaaactggagatcaagcgcaccgtggcagccccctctgtattcatttttcctccatccgacgaacagctaaaatcaggtactgctagcgtggtctgcctcctgaataacttctacccccgagaggcaaaggtgcagtggaaggttgataatgcccttcagagtgggaactctcaagaatccgtgacagagcaggacagcaaagattcgacctattctctgtcctcaacgttgactctcagtaaggctgactacgagaaacacaaggtctacgcctgtgaagtgacccatcagggactgagctcccctgtaacaaaatcttttaatcgtggcgagtgc

SEQ ID NO: 23222 - RNA, 1344 nt, synthetic construct
  misc_feature 1..1344: note = derived and/or modified sequence opt3 from Fibatuzumab_HeavyChain1
  source 1..1344: mol_type = other RNA
caggtgcaactggtccagagcggcgccgaggttaagaaacccggggcttccgtgaaggtatcttgcaaagcatcaggatacaccttcacaggttattggatgaactgggtgagacaggcccctggccaggggctcgaatggatgggagacatctacccaggcagtggtaatactaactatgatgagaagtttcaagggagggtcacgatgacccgggacacaagcatttccactgcgtacatggaactttctcgcctgcgatcggatgacaccgctgtgtattactgtgcccgtggaggctattacgaggatttcgactcatggggccaggggacaaccgttactgtgagcagtgcatccacaaaaggaccgtctgtctttcccttggcccctagctccaagtcaaccagtggtggcacggctgcattagggtgcctggtgaaggattacttcccagaacccgtaactgttagctggaactctggagccctaacctccggcgtgcacacatttcctgctgtcctccagtcaagcggtctgtatagtctttcttccgtggtgactgtcccaagctcgtctctggggacccagacatacatatgtaatgttaatcataaaccctccaacaccaaggtggacaaaagagtagagcctaagtcatgcgataaaacgcacacttgtccaccgtgccccgcccctgagttgctcggaggcccaagtgtgttcctgtttccccctaagccaaaggacacactgatgatcagcaggacccccgaagtcacttgtgtggttgtggatgtctcccatgaggacccggaagtgaaattcaattggtatgtagatggcgttgaggtgcacaacgcgaagacaaaacctcgggaggaacaatacaattctacctatcgcgtcgtgagcgtcctcacggtgttacatcaggactggctgaacgggaaggagtacaaatgcaaggtttcaaataaagcacttcccgccccaattgaaaagaccatcagtaaggctaaaggacagcctagagagccccaggtgtatacattgccaccctccagggaagagatgactaagaaccaagtaagcctgacctgtctagtcaaaggtttttacccttctgacattgccgtggagtgggaatcaaatggccagccagagaacaattacaagacaactccgcccgttctcgatagtgacgggagcttctttctgtattccaaacttaccgtggataagtctcggtggcagcaaggaaacgtcttctcgtgcagcgtgatgcacgaagcactgcacaaccattacacacagaagtccttgtcactcagtcctggcaaa

SEQ ID NO: 23223 - RNA, 642 nt, synthetic construct
  misc_feature 1..642: note = derived and/or modified sequence opt3 from Fibatuzumab_LightChain1
  source 1..642: mol_type = other RNA
gacatccagatgacccaaagcccctccttcctgtctgcctcagtgggcgatagagtcacaattacttgcagggctagtcaggggataatcagctacctcgcatggtatcagcagaagcctgagaaagccccaaagcggcttatttacgcggcttcctctctgcaatcgggagttccgtcacgctttagcggtagtggctccgggacggagttcaccttgacaatctctagcttacagcccgaagactttgccacttattactgtggacagtatgcaaactacccttataccttcggccagggtacaaaactggaaattaagcgaaccgtggccgctccatccgtatttatctttcccccttcagatgagcaactaaaaagtgggactgcaagcgtggtctgcctcctgaataacttctacccacgtgaagccaaggtgcagtggaaggttgacaatgcccttcagtctggaaactcccaggagtcagtgacagagcaagatagcaaagacagtacctactctctgtccagcacgttgactctctcgaaggctgattatgaaaaacacaaggtctacgcgtgtgaggtgacccatcagggcctgtcttcccccgtaacaaaatcattcaatagaggcgaatgc

SEQ ID NO: 23224 - RNA, 1344 nt, synthetic construct
  misc_feature 1..1344: note = derived and/or modified sequence opt3 from Ficlatuzumab_HeavyChain1
  source 1..1344: mol_type = other RNA
caggtgcaactggtccagcccggcgccgaggttaagaaacctgggaccagcgtgaagctctcctgcaaggcttctggatacacattcactacgtattggatgcactgggtaagacaggcaccaggtcagggccttgaatggatcggggagattaacccgaccaatggacatacaaactacaatcaaaaatttcagggcagggccactctgaccgtggacaaatcaacaagtaccgcgtatatggaattgagctccttacggtctgaggatactgctgtctactattgtgcccgcaactacgtgggttcgatattcgactattgggggcagggaacactgctaaccgtttcaagcgcaagtacgaagggcccctccgtgtttcctctcgccccatctagcaagtccacttcaggcgggaccgctgcactgggatgccttgtcaaagattacttccccgaacctgtgacagtaagttggaatagcggtgccctgacttctggcgttcacacctttccagctgtgttgcagtcctcagggctctacagcctgagttctgtcgtgacagtgccctccagctcgctgggaacccaaacgtatatctgtaacgtcaatcataagccttctaacactaaagttgacaagcgagtggagccaaaatcctgcgataagacacacacctgtccgccctgccctgccccagagctcttaggcggtccctcagtattcctgtttcctccaaagcccaaagacactcttatgattagtcgtacaccggaagtgacctgtgtcgtggttgatgtgagccatgaggaccctgaagtcaagttcaattggtacgtggatggggtagaggttcacaacgcgaaaacgaagcccagagaggaacagtataattccacctacagggtggtctctgtgttgacagtcctgcaccaggactggctaaacggaaaagagtataagtgcaaagtgagcaataaggcactcccagcccctatcgaaaagactatttcaaaagctaagggccagccccgggagccacaagtttacaccctgccccctagtcgcgaagagatgactaaaaaccaggtgtcccttacatgtctggtaaagggcttttatccaagcgatatcgccgtcgagtgggaatctaatgggcagccggagaacaactacaaaaccacaccccctgtgttggactcagatggaagtttctttctctacagcaagctgaccgttgacaagtccagatggcaacagggtaatgtgttctcttgctcggtcatgcatgaagcattacacaaccattatactcagaaaagcctgtccctctcaccaggcaag

SEQ ID NO: 23225 - RNA, 1341 nt, synthetic construct
  misc_feature 1..1341: note = derived and/or modified sequence opt3 from Ficlatuzumab_HeavyChain
  source 1..1341: mol_type = other RNA
gtgcagctggtccaacccggcgccgaggttaagaaacctgggaccagcgtgaagctctcctgcaaggcttctggatacacattcactacgtattggatgcactgggtaagacaggcaccaggtcagggccttgaatggatcggggagattaacccgaccaatggacatacaaactacaatcagaaatttcaaggcagggccactctgaccgtggacaaatcaacaagtaccgcgtatatggaattgagctccttacggtctgaggatactgctgtctactattgtgcccgcaactacgtgggttcgatattcgactattgggggcagggaacactgctaaccgtttcaagcgcaagtacgaagggcccctccgtgtttcctctcgccccatctagcaagtccacttcaggcgggaccgctgcactgggatgccttgtcaaagattacttccccgaacctgtgacagtaagttggaatagcggtgccctgacttctggcgttcacacctttccagctgtgttgcagtcctcagggctctacagcctgagttctgtcgtgacagtgccctccagctcgctgggaacccagacgtatatctgtaacgtcaatcataagccttctaacactaaagttgacaagcgagtggagccaaaatcctgcgataagacacacacctgtccgccctgccctgccccagagctcttaggcggtccctcagtattcctgtttcctccaaagcccaaagacactcttatgattagtcgtacaccggaagtgacctgtgtcgtggttgatgtgagccatgaggaccctgaagtcaagttcaattggtacgtggatggggtagaggttcacaacgcgaaaacgaagcccagagaggaacaatataattccacctacagggtggtctctgtgttgacagtcctgcaccaggactggctaaacggaaaagagtataagtgcaaagtgagcaataaggcactcccagcccctatcgaaaagactatttcaaaagctaagggccagccccgggagccacaggtttacaccctgccccctagtcgcgaagagatgactaaaaaccaagtgtcccttacatgtctggtaaagggcttttatccaagcgatatcgccgtcgagtgggaatctaatgggcagccggagaacaactacaaaaccacaccccctgtgttggactcagatggaagtttctttctctacagcaagctgaccgttgacaagtccagatggcagcaaggtaatgtgttctcttgctcggtcatgcatgaagcattacacaaccattatactcagaaaagcctgtccctctcaccaggcaag

SEQ ID NO: 23226 - RNA, 642 nt, synthetic construct
  misc_feature 1..642: note = derived and/or modified sequence opt3 from Ficlatuzumab_LightChain1
  source 1..642: mol_type = other RNA
gacatcgtgatgacccagagccccgattccctggccatgtctctcggcgagagagtcacacttaactgcaaggcttcagaaaatgttgtgagttacgtaagctggtatcaacagaaacctgggcagtccccaaagctgttgatttacggagcatctaacagggagtcgggtgtgccggaccggttctcaggcagcgggagtgccactgattttacgttaaccatatcctctgtccaggcggaagacgtggctgattatcactgtggacaaagctacaattatccctacacattcggccagggtactaaactggagatcaagcgcaccgttgccgcaccttccgtgtttattttcccaccctcagacgaacagctaaaaagtgggacagccagcgtcgtgtgcctcctgaacaatttttatcctcgagaggctaaggtacagtggaaggttgataacgcacttcaatctggaaattcccaggagtcagtgaccgaacaggacagcaaagatagtacttactctctgtccagcacattgaccctctcgaaggccgactacgagaaacataaggtctatgcttgtgaagtgacgcaccagggcctgtcttccccagtgactaaatcattcaaccgtggcgagtgc

SEQ ID NO: 23227 - RNA, 1350 nt, synthetic construct
  misc_feature 1..1350: note = derived and/or modified sequence opt3 from Figitumumab_HeavyChain1
  source 1..1350: mol_type = other RNA
gaggtgcagctgctcgaaagcggcgggggacttgtccaacccggtggctccctgagattgtcttgcaccgcctcagggttcacatttagtagctacgctatgaactgggttaggcaggcacctggaaagggcttagagtgggtgtccgccatctctggttcagggggaactacgttctatgcggactcggtaaaaggccggtttaccattagccgcgataatagtcgaacaactctgtacctacagatgaactccctccgtgctgaagacaccgccgtgtattactgtgcaaaggatctgggctggtctgacagctattactattactacgggatggatgtctggggacagggtacaaccgtgactgtttcctcagccagtacaaaaggcccaagcgtgttcccgcttgctccctgctctagatccacctcagagagcacggcagccctggggtgtttggtcaaggactattttcctgaaccagtgactgtaagttggaactctggagctctcacctccggcgttcacacattccccgccgtgctgcaaagctcgggtctgtactctctctcctcagtcgtgactgtgcctagtagcaattttgggacccagacatatacctgcaatgtcgatcataaaccatccaacacgaaggttgacaagactgtggagaggaaatgttgcgtagagtgtcccccttgcccagcgccgcccgtggcaggaccttctgtcttcttatttccacccaagcctaaagatacactgatgataagccggaccccagaagtgacttgtgttgtggtcgacgtgtcacacgaggatcccgaagtacagttcaattggtacgttgacggcgtggaggtccataacgccaagacaaaaccgcgcgaggaacagtttaatagtaccttcagagtggtctccgtgcttacggttgtgcaccaagattggttgaacggcaaggagtataagtgcaaagtaagcaataaggggctgcctgctcccatcgagaaaaccatttctaagacaaaaggacagccaagggaacctcaggtctacactctacccccatcacgggaagagatgaccaagaaccaggtgagtctcacatgtctggttaaaggtttttatcccagcgacatcgccgtggagtgggaatccaatggccaacctgagaacaattacaagactaccccaccgatgcttgactctgatgggtcgttcttcctgtacagcaagttgacagtcgacaaatcccgctggcagcagggaaacgtgttttcatgcagtgtaatgcatgaagcactccacaaccactatacccaaaagtctctgagcttatcccccggc

SEQ ID NO: 23228 - RNA, 642 nt, synthetic construct
  misc_feature 1..642: note = derived and/or modified sequence opt3 from Figitumumab_LightChain1
  source 1..642: mol_type = other RNA
gacatccagatgacccaattccccagctccctgtctgcctcagtgggcgatagagtcacaattacttgcagggctagtcaggggatacggaacgacctcggatggtaccagcagaagcctggtaaagcaccaaagcgccttatctatgccgcgagccgactgcaccgtggcgttccgtccagattttctgggtcgggatcaggcacggagttcaccttgacaattagcagtttacaacccgaagattttgctacttactattgtctgcagcataattcctacccttgctctttcggtcaggggaccaaactagagatcaagaggacagtggccgcaccaagcgtatttatttttcccccttccgacgaacagctcaaatcaggaaccgccagtgtggtctgtctgcttaacaatttctatccacgggaggctaaggtgcaatggaaggttgataacgcactgcagagcggcaattctcaggaatccgtgactgagcaggactcaaaagatagcacatacagtttgtcttccaccctcacgctgagcaaggccgactatgagaaacacaaggtctacgcttgcgaagtgactcatcaaggcctgtcgtctcccgtaaccaaatccttcaaccgcggggagtgt

SEQ ID NO: 23229 - RNA, 1359 nt, synthetic construct
  misc_feature 1..1359: note = derived and/or modified sequence opt3 from Firivumab_HeavyChain1
  source 1..1359: mol_type = other RNA
caggtgcaactggtccagagcggcgccgaggttaagatgcccgggtcctctgtgaaagtatcatgcaagaccagtggagtgttctttagctcccacgctatctcttgggtcagacaggcacctggtcagggcctcgaatggatgggagggatttcgccaatgttcggcacaactcattacgcccaaaaatttcagggtagggtgacgataaccgcggaccagtcaacaactaccgcttatatggagcttacaagcctgaccagtgaagatactgccgtttactattgtgcacgggacggggccggatcctactatccgttgaactggttcgatccctggggccagggcacattagtgaccgtctctagcgcttccacgaaggggccttcagtgtttccactggcacccagtagcaaatctacttccggaggtaccgccgctctaggctgcctcgtaaaggactacttccctgagccagttacagtgtcatggaatagcggggccctgacaagtggagtccacacctttcccgcggtgcttcaatcttccggcctgtatagcttgtcgtctgtggtcacagttccttcctcaagtctcggtacccagacgtacatctgtaacgtgaatcataagccaagcaacactaaagtagataagcgcgtggaaccgaaatcctgcgacaagacacacacctgtcccccttgcccagcacccgagctgctcgggggaccttctgtcttcctgtttccacccaaaccgaaggatactttaatgattagccgaacacctgaggtgacctgtgttgtggtcgacgtgtcacatgaagatcccgaggtaaagttcaattggtacgttgacggcgtggaagtccacaacgccaaaacgaagccacgtgaggagcagtataatagtacctacagagtggtctccgtgctgacagttcttcaccaggattggttgaacggcaaagaatataagtgcaaagtgagcaataaggctctgcctgcccccatcgagaaaactatttctaaggcaaaggggcaaccaagggaaccccaggtatacaccctacctccatcacgggacgagctcactaaaaaccaggtcagtctgacttgtcttgtgaagggattttatccgagcgatatcgctgttgaatgggagtccaatggtcaacccgagaacaattacaaaaccacacctccagtgctggactctgacggctcgttctttttgtatagcaagctcaccgtcgataaatcccgctggcagcaggggaacgtgttctcatgcagtgtaatgcatgaaggactgcacaatcattacactcagaagtctttaagcctgtcccccggcaag

SEQ ID NO: 23230 - RNA, 642 nt, synthetic construct
  misc_feature 1..642: note = derived and/or modified sequence opt3 from Firivumab_LightChain1
  source 1..642: mol_type = other RNA
gagatcgtgctgacccagagccccgccacactctccctttctcctggcgaaagagctactctgtcatgcagggcaagtgagaacatttggaataacttggcctggtaccaacagaagccagggcaggcgccgcggttactgataagcggagcttccacgggtgccaccggcgtcccctctcgcttccgagggtcgggatcacgtacagaatttactctaaccatcagcagtctccagtccgaggacttcgcaatttatttttgtcaacagtacaattcttggcctagaacattcggcccaggtaccaaagttgaaatcaagaggactgtggccgctcccagcgtatttattttccctccatccgatgagcagctgaaatcagggacagcaagtgtggtctgccttctgaacaatttttatccccgggaggccaaggtgcagtggaaagttgacaacgctttgcaaagcggaaattctcaggaatccgtgaccgagcaggattcaaaggacagcacgtacagtctctcttccactctgaccctgagcaaggccgattatgaaaaacacaaggtctacgcgtgtgaggtgacacatcagggcctctcgtctcctgtaactaaatccttcaaccgcggcgagtgc

SEQ ID NO: 23231 - RNA, 1347 nt, synthetic construct
  misc_feature 1..1347: note = derived and/or modified sequence opt3 from Flanvotumab_HeavyChain1
  source 1..1347: mol_type = other RNA
caggtgcaactggtccagagcggctccgagctcaagaaacccggggcctctgttaagatctcatgcaaagctagtggatacaccttcacaagctatgcaatgaactgggtgagacaggcccctggtcagggccttgaatccatggggtggattaatactaacacgggaaatccaacctacgcgcaaggctttacaggtaggttcgtattttctatggacacttcggtgtcaaccgcttatctgcagataagcagtttgaaggccgaggatacagcaatctactattgtgccccgcggtactcctctagctggtatttagactactgggggcagggaaccctggtcactgtgtcctcagctagtacaaaaggccccagcgttttccctctagcaccatcttccaagtcaaccagcggcgggacggccgctctcggatgcctggtgaaggattactttcccgaacctgtcactgtgagttggaactctggtgcccttacctccggcgtacacacattcccagcggttctgcagagctcggggttgtattctctctcctcagtggtcactgtgcccagtagctccctgggaacccaaacatacatttgtaatgtgaaccataaaccttctaataccaaggtcgacaaacgcgttgagccaaagagctgcgataaaacgcacacttgtccgccctgccctgcaccagaactgctcggcggtccctcagtgtttttattccctccaaagcccaaggacacactgatgatcagtcgaaccccggaggtaacttgtgtggtcgtggatgtttcccatgaggaccctgaagtgaaatttaactggtatgtcgatggggtggaggtacacaatgccaagacaaaaccccgtgaggaacagtacaacagcacctatagagttgtgtctgtccttacggtgttgcatcaggactggctgaatggaaaggagtacaaatgcaaggtctcaaacaaagctctaccagcccctattgaaaagaccatcagtaaggcaaaaggccagcccagggagccacaagtgtatacactgccccctagccgggaagagatgactaagaatcaggtttccctcacctgtcttgtgaaaggcttctacccatctgatatagctgtagaatgggagtcgaacgggcagccggagaataactacaagacaactccccctgtcctggacagcgatggatcctttttcttgtattcaaaactcaccgtggacaagagtcgctggcaacagggtaacgtgttttcttgcagcgttatgcacgaagccctgcacaatcattacacacagaagtccttatcactgagcccaggcaaa

SEQ ID NO: 23232 - RNA, 645 nt, synthetic construct
  misc_feature 1..645: note = derived and/or modified sequence opt3 from Flanvotumab_LightChain1
  source 1..645: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggctgatgtatacctttggacagggcacaaaacttgagattaagagaaccgtggctgcaccatccgtattcatctttcccccttcagatgaacagctgaaaagtggtactgccagcgtggtctgcttgctcaacaatttctacccaagggaggctaaggtgcaatggaaagttgacaacgccctgcagtctggaaattcccaggagtcagtgacagaacaggatagcaaggacagtacctattctctgtccagcacgctcactttatcgaaggcggattacgagaaacacaaggtctacgcatgtgaagtgacccatcaagggctgtcttcccccgtaacaaaatcatttaaccggggcgagtgc

SEQ ID NO: 23233 - RNA, 1362 nt, synthetic construct
  misc_feature 1..1362: note = derived and/or modified sequence opt3 from Fletikumab_HeavyChain1
  source 1..1362: mol_type = other RNA
caggtgcaactggtccagagcggcgccgaggttaagagacccggggcttccgtgaaagtatcttgcaaggcatcaggatacaccttcacaaacgacatcattcactgggtgaggcaggcccctggtcagcggctcgaatggatgggctggataaatgcggggtatggaaacactcaatacagtcagaattttcaggatcgcgtcagcatcacgcgagacacctccgcttctacagcctatatggagcttatttcgctgcgttcagaagatactgcagtgtactattgtgccagagagccattgtggttcggcgaaagcagtccgcatgactactatggtatggatgtttgggggcagggaaccacagtgaccgtctcctctgctagcactaaaggcccctccgtgtttcctttagcaccatgctcaaggagtacaagcgagtctaccgccgctctgggctgtctagtaaaggactacttccccgagcctgttacggtgtcctggaactcaggggccctcactagcggagtccacacctttccagcggtgctgcaaagttctggtctttactccctgagctcggtggtcacagttccctcttcctcattgggcactaaaacctatacatgcaatgtggatcataagcctagtaacaccaaggtagacaaacgggtggaaagcaagtacgggccaccgtgtcccccttgcccagcacccgagttcctcggaggcccttccgtctttctgttcccacccaaaccgaaggatacgctgatgatctctcgcactcctgaagtgacatgtgttgtggtcgacgtgagccaggaggatcccgaggtacagtttaattggtatgttgacggtgtggaagtccacaacgccaaaaccaagccaagagaggaacagttcaattcaacttacagggtggtcagtgtgctcacagttttacatcaagattggctgaacgggaaggagtataaatgcaaggtgtccaataaaggacttcctagctctattgaaaagaccatctcaaaagctaagggccagccccgggagccacaggtatacacgttgccccctagtcaagaggaaatgaccaaaaaccaggtcagcctgacatgtctagtgaagggcttttatccatccgacatagccgttgagtgggaatctaatgggcagccggagaacaattacaagactacaccccctgtgctcgactcggatggtagcttctttctgtactcccgccttaccgtcgacaaatcacgatggcaggaaggaaacgtgttcagttgctctgtaatgcacgaggcactgcacaaccattatactcaaaagagcttgtccctctcactgggcaaa

SEQ ID NO: 23234 - RNA, 642 nt, synthetic construct
  misc_feature 1..642: note = derived and/or modified sequence opt3 from Fletikumab_LightChain1
  source 1..642: mol_type = other RNA
gccatccagctgacccaaagcccctcctctctctcagctagtgtgggcgacagagtcacaattacttgcagggcaagccaggggatatcctctgcccttgcgtggtaccagcagaagcctggaaaagctccaaagctgttgatctatgatgcctcgtcattagagagcggtgttccgagtcggttctccggctctgggagcggaacggactttaccctgacaatttcctcactacaacccgaagatttcgcaacttactattgtcagcagtttaacagttaccctctcaccttcggcggtgggacaaaagtggagatcaagcgcaccgtagccgctccaagcgtgtttatttttcccccttctgacgaacagctgaaatccggaactgcatcagtcgtgtgccttctgaataacttctatccacgagaggccaaggttcaatggaaggtggataatgctttgcagagcggcaacagtcaggaatctgtcacagagcaggactccaaagatagcacctactcgctctcttccacgctgactctgtcaaaggccgactatgagaaacacaaggtgtacgcgtgtgaagtaacccatcaaggcctcagtagccccgttacaaaatccttcaatcgtggggagtgc

SEQ ID NO: 23235 - RNA, 1341 nt, synthetic construct
  misc_feature 1..1341: note = derived and/or modified sequence opt3 from Fontolizumab_HeavyChain1
  source 1..1341: mol_type = other RNA
caggtgcaactggtccagagcggcgccgagctcaagaaacccgggtcctctgttaaggtgtcatgcaaagctagtggatacatcttcaccagctcctggattaactgggtaaagcaggcacctggtcagggccttgaatggatagggagaatcgacccatctgatggagaggtgcactataatcaagactttaaagataaggccacactgactgtcgacaagtcgacgaacaccgcgtacatggaattgtctagcttaaggagtgaggatacagctgtgtattactgtgcccggggcttcctgccgtggtttgcagactggggtcaggggactctagttaccgtgtcctctgccagcacaaaaggaccctccgtcttccctctcgctccatcaagtaagagcacctctggcggcactgcagccctggggtgccttgtgaaagattattttcccgaacctgtaacagtttcctggaactcaggagctctgaccagcggtgtgcatacgttcccagccgtcttgcagagttctggcctctactccctgagctcggtggtgactgtcccctcttcctcactggggacccagacatatatttgtaatgttaatcacaagcctagtaacactaaagtggacaagaaggtagagccaaaaagctgcgataagacccatacatgtccgccctgccctgcgccagagctcttaggaggcccctccgtgtttctgttccctccaaaacccaaggacacccttatgatctctcgcacgccggaagtcacttgtgtggttgtggatgtcagccacgaggaccctgaagtgaaatttaattggtacgtagatggtgttgaggtgcataacgcaaagacaaaaccccgagaggaacaatacaattcaacctatcgtgtcgtgagtgtcttgactgtgctgcaccaggactggctaaacgggaaggagtacaagtgcaaagtttccaataaggccctcccagctcctattgagaaaacaatcagcaaggccaaaggacagcccagagaaccacaggtgtataccctgcccccttctagggacgaacttacgaagaaccaagtatcactgacctgtttggtcaagggcttctacccaagtgatatagcagtggagtgggagagcaatggccagccggaaaacaattataaaacaactccccctgttctcgactccgatgggtcatttttcctgtactcgaagttaaccgtggacaaaagccggtggcagcaaggaaacgtcttttcctgctcagtgatgcacgaggctctgcataaccactatacacagaagagtctctctcttagcccaggtaaa

SEQ ID NO: 23236 - RNA, 642 nt, synthetic construct
  misc_feature 1..642: note = derived and/or modified sequence opt3 from Fontolizumab_LightChain1
  source 1..642: mol_type = other RNA
gacatccagatgacccaaagcccctccacactgtctgcctcagtgggcgatagagtcactattacgtgcaaggctagtgagaacgttgacacctacgtgagctggtatcagcagaaacctgggaaggcaccaaaactccttatatacggagcctccaataggtatacaggtgtaccgtctcggttctcgggctcagggagcggaactgattttaccctgacaatcagttccttgcagcccgacgatttcgcgacctactattgtggccaatcttacaactatccttttactttcggtcaggggacaaaggtggaagtcaaacgcaccgtggctgccccaagcgtttttatttttcccccttccgacgagcagttaaagtcaggaacggcaagtgtggtctgcctgctaaataacttctacccacgagaagccaaggtgcagtggaaagtagataatgctctccaaagcggcaactctcaggagtccgttactgaacaggactcaaaggatagcacctacagtctgtcttccacacttactctgagcaaagcagactatgagaagcacaaagtgtacgcctgtgaggtcacccatcagggcttgtcgtctcccgtgacaaagtccttcaatcgtggggaatgc

SEQ ID NO: 23237 - RNA, 1344 nt, synthetic construct
  misc_feature 1..1344: note = derived and/or modified sequence opt3 from Foralumab_HeavyChain1
  source 1..1344: mol_type = other RNA
caggtgcaactggtcgagagcggcgggggagttgtgcagcccggtagatccctcaggctttcttgcgccgcttcaggcttcaagtttagtgggtacggaatgcactgggtacggcaggcacctggcaaaggtctggaatgggtggccgtcatctggtatgacgggagcaagaaatactatgtggattccgttaagggacgcttcaccatttctcgagacaactcgaaaaatacattgtacttacagatgaactcactgcgtgcggaggatactgctgtgtattactgtgccagacaaatgggctattggcattttgacctatggggcagggggacgctcgtcaccgtgagcagtgcatccacaaagggaccatctgtattcccgctggcccccagctccaagtcaacttctggtggcaccgctgcacttgggtgcctggttaaagattactttcctgaaccagtgacagtcagctggaatagtggagccttgacctccggcgtgcacactttccccgctgtgctccagtcaagcggtctgtacagtctgtcttccgtcgttacagtgcctagctcgtctctcgggacccagacgtatatatgtaacgtaaatcataagccatccaacactaaagtggacaagcgggtcgagcccaaatcatgcgataagacccacacatgtcctccatgcccggcccccgaagcggagggaggccctagtgtgtttttattcccacccaagcctaaagacactctgatgatcagccgcaccccagaggttacatgtgtggtcgtggatgtatcccatgaagaccccgaggttaagtttaattggtacgtggatggcgtcgaagtgcacaacgcaaaaaccaagccgagagaggagcagtataattctacgtacagggtcgtgagcgttcttactgtgttgcaccaagactggctgaacgggaaagaatataagtgcaaagtatcaaataaggccctacctgctcccattgagaagacaatcagtaaagccaagggacagccacgggaacctcaggtctacaccctgcccccatcccgcgaggaaatgactaaaaaccaggtgagcctcacatgtcttgttaagggtttctatccctctgatattgcagtggagtgggagtcaaatggccaacctgaaaacaattacaaaaccacgccaccggtcctggacagtgacgggagctttttcttgtactccaagctcaccgtggataagtctcgatggcagcagggaaacgtattttcgtgcagcgtgatgcatgaggctctgcacaaccattatacacaaaaatccttatcactgagtcccggcaag

SEQ ID NO: 23238 - RNA, 645 nt, synthetic construct
  misc_feature 1..645: note = derived and/or modified sequence opt3 from Foralumab_LightChain1
  source 1..645: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccacccctgacctttggaggcggtacaaaagtggagattaagagaaccgtagctgcaccttccgtgttcatctttccaccctcagatgaacagcttaaaagtgggactgccagcgtcgtgtgcctgttgaacaatttctatcctagggaggctaaggttcagtggaaagtggacaacgccctccaatctggaaattcccaggagtcagtcacagaacaggatagcaaggacagtacctactctctgtccagcacgctgactctctcgaaggcggattatgagaaacacaaggtgtacgcatgtgaagtaacccatcagggcttatcttccccagttacaaaatcatttaaccggggcgagtgc

SEQ ID NO: 23239 - RNA, 1344 nt, synthetic construct
  misc_feature 1..1344: note = derived and/or modified sequence opt3 from Foravirumab_HeavyChain1
  source 1..1344: mol_type = other RNA
caggtgcaactggtcgagagcggcgggggagccgttcagcccggtagatccctcaggctttcttgcgctgcatcaggcttcacctttagtagctacgggatgcactgggtgcggcaggcccctggaaagggcctggaatgggtagcggtgatcttgtatgacggttccgataaattctacgctgactctgtcaaggggcgctttacaatttcgcgagataacagcaaaaatactttatatctgcagatgaactcactacgtgccgaggacacggcagtgtactattgtgccaaggttgctgtggcaggaacccatttcgattactggggccaaggcacactcgtcactgtgagttccgcctctaccaaagggccaagcgtatttccgctggctccctcctcaaagagtacaagcggaggtaccgccgcgcttggctgcctggttaaggactatttccctgaaccagtgactgtctcttggaactccggggcattgacatcaggagtgcacacctttcccgccgtgctccagagcagtggcctgtactctctgtccagcgtcgttacggtgccttcgtcttccctcggtactcagacctacatatgtaatgtaaatcataaaccatcaaacacaaaggtggataaaagagtcgagcccaagagttgcgacaaaactcacacctgtcctccatgcccggctcccgaattacttgggggacctagcgtgttcctgtttccacccaagcctaaggatacattgatgatctccaggaccccagaggttacgtgtgtggtcgtggacgtatctcatgaggatcccgaagttaaattcaattggtatgtggacggcgtcgaggtgcacaacgccaagactaaaccgcgggaggaacagtacaatagcacatatcgcgtcgtgtcagttctgaccgtgctacaccaagattggctcaacggcaaggagtacaaatgcaaggtaagtaataaagcactgcctgctcccattgaaaagactatctccaaggccaaagggcagccaagagagcctcaggtctatacacttcccccaagcagggaagagatgaccaagaaccaggtgtctctgacgtgtttggttaaaggattttacccctcagacattgcggtggaatgggagagtaatggtcaacctgagaacaattataagaccacaccaccggtcctcgacagcgatggctccttctttctgtactctaaattaactgtggacaagtcgcggtggcagcaggggaacgtattcagctgctccgtgatgcatgaagccctgcacaaccattacacccaaaagtcactcagtctttctcccgga

SEQ ID NO: 23240 - RNA, 1344 nt, synthetic construct
  misc_feature 1..1344: note = derived and/or modified sequence opt3 from Foravirumab_HeavyChain
  source 1..1344: mol_type = other RNA
gaggtgcagctggtcgaaagcggcgggggagccgttcaacccggtagatccctcaggctttcttgcgctgcatcaggcttcacctttagtagctacgggatgcactgggtgcggcaggcccctggaaagggcctggagtgggtagcggtgatcttgtatgacggttccgataaattctacgctgactctgtcaaggggcgctttacaatttcgcgagataacagcaaaaatactttatatctgcagatgaactcactacgtgccgaagacacggcagtgtactattgtgccaaggttgctgtggcaggaacccatttcgattactggggccagggcacactcgtcactgtgagttccgcctctaccaaagggccaagcgtatttccgctggctccctcctcaaagagtacaagcggaggtaccgccgcgcttggctgcctggttaaggactatttccctgagccagtgactgtctcttggaactccggggcattgacatcaggagtgcacacctttcccgccgtgctccaaagcagtggcctgtactctctgtccagcgtcgttacggtgccttcgtcttccctcggtactcagacctacatatgtaatgtaaatcataaaccatcaaacacaaaggtggataaaagagtcgaacccaagagttgcgacaaaactcacacctgtcctccatgcccggctcccgagttacttgggggacctagcgtgttcctgtttccacccaagcctaaggatacattgatgatctccaggaccccagaggttacgtgtgtggtcgtggacgtatctcatgaagatcccgaggttaaattcaattggtatgtggacggcgtcgaagtgcacaacgccaagactaaaccgcgggaggagcagtacaatagcacatatcgcgtcgtgtcagttctgaccgtgctacaccaggattggctcaacggcaaggaatacaaatgcaaggtaagtaataaagcactgcctgctcccattgagaagactatctccaaggccaaagggcaaccaagagaacctcaggtctatacacttcccccaagcagggaggaaatgaccaagaaccaggtgtctctgacgtgtttggttaaaggattttacccctcagacattgcggtggagtgggagagtaatggtcagcctgaaaacaattataagaccacaccaccggtcctcgacagcgatggctccttctttctgtactctaaattaactgtggacaagtcgcggtggcaacaggggaacgtattcagctgctccgtgatgcatgaggccctgcacaaccattacacccagaagtcactcagtctttctcccgga

SEQ ID NO: 23241 - RNA, 642 nt, synthetic construct
  misc_feature 1..642: note = derived and/or modified sequence opt3 from Foravirumab_LightChain1
  source 1..642: mol_type = other RNA
gacatccagatgacccaaagcccctcctctctgtcagccagtgtgggcgatagagtcacaattacttgcagggctagccaggggatacggaacgacctcggatggtaccagcagaagcctggtaaagcaccaaaacttctgatctatgccgcgtcctctttgcaatcgggcgttccgtcacgcttcagcgggagtggatccggcacggattttaccttaacaatttctagcctgcagcccgaggacttcgctacttactattgtcagcagctaaattcctaccctccaacctttggtgggggaacaaaggtggaaatcaagcgaaccgtagccgcaccctcagtgttcatttttcctccaagtgatgagcaactcaaaagcggcactgcctctgtcgtgtgcctgcttaacaatttctatccccgtgaagctaaggttcagtggaaggtggacaacgcactgcagtccggcaattcacaggagagcgtcacagaacaagatagtaaagactctacctactccttgagctcgacgctcactctgtctaaggccgattatgagaaacacaaggtgtacgcttgtgaggtaacccatcaggggctgtcctcacctgttacaaaaagttttaacagaggagaatgc

SEQ ID NO: 23242 - RNA, 1341 nt, synthetic construct
  misc_feature 1..1341: note = derived and/or modified sequence opt3 from Fresolimumab_HeavyChain1
  source 1..1341: mol_type = other RNA
caggtgcagctggtccagagcggcgccgaggttaagaaacccgggtcctctgtgaaggtatcatgcaaagctagtggatacaccttcagctccaacgtgatctcttgggtcagacaggcacctggtcagggcctcgaatggatgggaggggtgattccaatagttgacatcgccaattatgcgcaaaggtttaagggccgggtgacaattactgctgatgagtcgacgtcaaccacatacatggaacttagcagtctgcgctccgaggacactgccgtctattactgtgcatctaccttgggtttagtgctggatgccatggactattgggggcagggaacactcgtaaccgttagctccgcttcaactaaaggcccgagtgtgttccccctcgcaccttgcagccgatctacatccgaatcaaccgccgctctgggctgtcttgtcaaggattactttccagagcccgtgacggtgagctggaacagtggggccctgacttctggagtccacaccttccctgcggttttgcagtccagcggtctctattcgctgtcttccgtggtaacagtgccatcaagtagcctgggcactaagacctacacatgcaatgtcgaccataaaccctccaacaccaaggtggataaacgtgttgagtctaagtacgggcctccatgtccgagctgccccgcacctgaatttctcggaggcccatcagtgttcttatttccccctaaaccaaaggacacgctgatgatcagtagaactcccgaggtcacatgtgtggtagttgatgtgtcccaggaagacccggaggtccaattcaattggtatgtggatggtgtcgaggtgcacaacgccaagaccaaacctagggaggaacagtttaatagcacttaccgggttgtgtctgtacttacagtcttgcatcaggactggctgaacgggaaggaatataaatgcaaggtgtcaaataaaggactacccagtagcattgagaagaccatctccaaagctaagggccagccacgcgaacctcaagtttacacgctacccccatctcaggaggagatgaccaagaaccaggtgtcgctgacatgtcttgtcaaaggcttctatcccagcgatatagccgtggaatgggagtccaatgggcaacctgaaaacaattacaagactaccccaccggtactggactcagacggaagtttctttttgtattctagactcacagtggataaatccaggtggcaggagggtaacgtttttagctgctcagtcatgcacgaagcactgcataatcactacactcaaaagagcttatctctgtccctcggcaaa

SEQ ID NO: 23243 - RNA, 645 nt, synthetic construct
  misc_feature 1..645: note = derived and/or modified sequence opt3 from Fresolimumab_LightChain1
  source 1..645: mol_type = other RNA
gagaccgtgctgacacagagccccggcactctctccctttctcctggggaaagagccacgctgtcatgcagggctagtcagagcttgggatcctcttacttagcatggtatcaacagaagccaggtcaggccccgcggctgctaatctacggcgcgtcgtcacgcgctcccgggattcctgaccgattcagcggaagtggctccggtaccgattttacactcactatatctcgtctggagccagaagacttcgccgtctattactgtcaacagtatgcagatagccccatcacctttgggcagggaacaagacttgagattaaaaggaccgttgccgctccttccgtgttcatctttccaccctcagacgaacagctgaagagtggcactgcaagcgtagtgtgcttgctcaacaatttctaccctcgggaggccaaagtccaatggaaggtggataacgctctgcagtctggcaattcccaggagtcagttacagaacaggacagcaaagatagtacctattctctgtccagcacgctcactttatcgaaggccgactacgagaagcacaaagtgtacgcgtgtgaagtcacccatcaagggctgtcttccccagtgacaaagtcatttaaccgcggagagtgc

SEQ ID NO: 23244 - RNA, 1347 nt, synthetic construct
  misc_feature 1..1347: note = derived and/or modified sequence opt3 from Fulranumab_HeavyChain1
  source 1..1347: mol_type = other RNA
gaggtgcagctggtcgaaagcggcgggggactcgttcaacccggtggctcccttagactgtcttgcgccgcttcagggttcaccttgaggagttacagcatgaactgggtgcggcaggcacctggaaagggcttagagtgggtatcctatatctctcgctcgtcacacacaatattttacgccgacagcgtgaaaggtcgattcactattagtcgtgataatgcgaagaactccctgtatctacagatggactctctcagagatgaagacacggctatgtactattgtgccagggtctacagctccgggtggcatgtgtcagattattttgactactggggacagggcatcctggttaccgtgagtagcgcatctacaaaaggcccatccgtcttcccgcttgccccctgctcacggagcaccagtgagtctactgctgcactggggtgtttggtgaaggattactttcctgaaccagtaacagtttcctggaatagcggagccctcacctcgggtgtgcacactttccccgctgtcctgcaatcttccggcctgtattcactcagtagcgtggtgacagtcccttcctctaactttgggacccagacgtacacttgcaatgttgaccataaaccaagcaacaccaaggtggataagacagtagagcgcaaatgttgcgtggagtgtcccccttgcccagccccgcccgtcgcgggaccttcagtgttcttatttccacccaagcctaaagacactctgatgattagtagaaccccagaagttacatgtgtggtcgtggatgtatcccacgaggaccccgaagttcagttcaattggtatgtggatggcgtcgaggtgcataacgcaaagaccaaaccgagggaggaacagtttaatagcacgttccgggtcgtgtctgttcttactgtggtacaccaagactggttgaacggtaaggagtacaagtgcaaagtctcaaataaggggctgcctgcccccatcgagaaaacaattagtaagaccaaaggacagccacgcgaacctcaggtgtatactctacccccaagccgagaagagatgacaaagaaccaggtttccctcacctgtctggtgaaaggcttttacccctctgacatcgctgtcgagtgggaatcgaatggccaacctgagaacaattataagacgaccccaccgatgcttgatagcgacgggtccttcttcctgtactcaaagttgacagtggataaaagtagatggcagcagggaaacgtattttcttgcagcgtgatgcacgaagccctccataaccactacactcaaaagtccctgtcattaagccccggtaaa

SEQ ID NO: 23245 - RNA, 642 nt, synthetic construct; identical to SEQ ID NO: 23234
  misc_feature 1..642: note = derived and/or modified sequence opt3 from Fulranumab_LightChain1
  source 1..642: mol_type = other RNA

SEQ ID NO: 23246 - RNA, 1356 nt, synthetic construct
  misc_feature 1..1356: note = derived and/or modified sequence opt3 from Futuximab_HeavyChain1
  source 1..1356: mol_type = other RNA
gaggtgcagctgcaacagcccggcagcgaactcgtcagacctggggcctccgttaaactttcttgcaaggcttcaggatacaccttcacaagttattggatgcactgggtgaagcagaggccaggtcagggcctggagtggatcgggaacatttacccgggaagccggtccactaattatgacgaaaaatttaagtctaaagcaacgttgaccgtagatacatcgtcaagcactgcctacatgcaattaagttccctgacctctgaggacagcgcggtgtattactgtacacgcaacggcgattattacgtctcctcaggtgacgctatggattactgggggcagggaaccagtgtgactgttagctctgcctccacaaagggcccctcagtgttccctctagcaccaagcagtaagtctacctccggcgggacggccgctctcggatgcctggtcaaagactattttcccgaacctgtgactgtaagctggaactcgggtgcacttacctctggcgttcatacattcccagccgtgctgcagtcctcagggttgtacagtctcagctccgtcgtgactgtgccctctagctcactgggaacccagacatatatatgtaatgtcaatcacaagcctagtaacaccaaagttgataagcgagtggagccaaaatcctgcgacaagacgcatacttgtccgccctgccctgctccagagctgctcggcggtcccagcgtatttttattccctccaaagcccaaagatacactgatgatctctcgtaccccggaagtgacttgtgtcgtggttgacgtgtcacacgaggatcctgaagtcaagtttaattggtacgtggacggggtagaggttcataacgccaaaacaaagcccagagaggaacaatataatagtacctacagggtggtcagcgtgcttacggtcttgcaccaggattggctgaacggaaaagagtataagtgcaaagtgtccaataaggcgctaccagcacctattgaaaagaccatctctaaagccaagggccagccccgggagccacaggtttacacactgcccccttcgcgcgaagagatgactaaaaaccaagtgagcctcacctgtcttgtaaagggcttctacccatccgacattgctgtcgagtgggaatcaaatgggcagccggagaacaattataaaacaactccccctgtgctggacagtgatggatctttctttttgtacagcaagctcaccgttgacaagtccagatggcagcaaggtaacgtgttttcatgcagcgtcatgcacgaagccctgcataaccactatacacagaaatctttatccctgagtccaggc

SEQ ID NO: 23247 - RNA, 642 nt, synthetic construct
  misc_feature 1..642: note = derived and/or modified sequence opt3 from Futuximab_LightChain1
  source 1..642: mol_type = other RNA
gacatccagatgacccaaacaactagctccctgtctgcctcactcggcgatagagtgacgattagttgcaggaccagccaggacatagggaactaccttaattggtatcagcagaagcccgatggaacagtcaaactgttgatctactatacttcccggttacactctggtgttccttcgcgcttctcaggcagcgggagtggaaccgacttttccctgacaattaacaatgtggagcaagaagatgtagctacctacttctgtcagcattataacactgtgccaccgacatttggcggtgggaccaagctagagatcaaacgaacggtcgcagccccctctgtgttcatttttcctccaagcgacgaacagctcaagtccggaactgcgtcagttgtgtgcctgcttaataacttctacccccgtgaggctaaagtccagtggaaggtggataatgccctgcaaagtggcaacagccaggaatctgtaaccgagcaggactccaaggattcaacatatagcttgagttctactctcaccctgtccaaagcagactacgagaagcacaaagtttacgcctgtgaagtgacacatcagggcctgagctcgcctgtcaccaagtcttttaatagaggggagtgc

SEQ ID NO: 23248 - RNA, 1335 nt, synthetic construct
  misc_feature 1..1335: note = derived and/or modified sequence opt3 from Galcanezumab_HeavyChain1
  source 1..1335: mol_type = other RNA
caggtgcaactggtccagagcggcgccgaggttaagaaacccgggtcctctgtgaaggtatcatgcaaagctagtggatacaccttcggtaactattggatgcagtgggtgagacaggcacctggccaagggctcgaatggatgggagccatctacgagggcacaggtaagactgtctatattcagaaatttgcggacagggtgacgataaccgctgataagagcacatccactgcctacatggaactttcttcgctgcggtcagaggacaccgcagtttattactgtgcccgcttgagcgattatgtgagtgggttcggatactggggccagggcacaaccgtcactgtgtcctctgctagcacaaaggggccatccgtatttccgttagcaccctgctcacgaagtaccagcgaatctacggccgctctgggatgtctagttaaagactacttccctgagccagtgactgtctcctggaatagcggtgccctcaccagcggcgtgcacacatttcccgcggtgctgcagagttctgggctttattccctgagctcggtcgttactgtgccttcttcctcattgggaaccaagacatatacctgcaacgtagatcataaaccaagtaatacgaaggtggacaaacgtgtcgagagcaagtacggtcccccttgtccaccgtgccccgcacctgaagccgctggcgggccatccgtgttcctctttccccctaagccaaaagatactctgatgatctctagaacacccgaggttacctgtgtggtcgtggacgtaagccaagaagatccggaggttcagttcaactggtacgtggacggagtcgaggtgcacaatgccaagactaaacctagggaggaacagtttaactcaacatatcgggtcgtgagtgttctgaccgtgctccatcaggattggttaaatggcaaggaatacaaatgcaaggtatccaacaaaggcctgcccagctctattgagaagacgatctcaaaggcaaaagggcaaccacgcgaacctcaggtctatacccttcccccaagtcaggaggagatgacaaagaatcaagtgagcttgacttgtctggttaaaggattctacccctccgacattgctgtggaatgggagtctaacggtcagcctgaaaataactacaagaccacaccaccggtcctagattcggacggcagctttttcctctattccagactgactgtggacaaatcaaggtggcaggaggggaatgtatttagttgctctgtgatgcacgaagcccttcataaccactacacccagaagtcactgtccttgtcactcgga

SEQ ID NO: 23249 - RNA, 642 nt, synthetic construct
  misc_feature 1..642: note = derived and/or modified sequence opt3 from Galcanezumab_LightChain1
  source 1..642: mol_type = other RNA
gacatccagatgacccaaagcccctcctctctgtcagccagtgtgggcgatagagtcacaattacttgcagggctagcaaggacatatccaaatacctcaactggtatcagcagaagcctgggaaagcaccaaaacttctgatctactatacgtctggataccactcgggtgttccgtcacggttcagcggcagtgggtccggaaccgattttacattgactatttctagcttacagcccgaggacttcgccacctattactgtcaacagggcgatgcgctgcctccaacatttggtgggggaaccaaggtggaaatcaagcgcactgtagctgccccctccgtgttcatttttcctccatcagacgagcagctaaagagtggcacagcaagcgtcgtgtgcctcctgaataacttctatccccgagaagccaaagttcagtggaaggtggataatgcacttcaatctggcaactcccaggagtcagtcaccgaacaggacagcaaagatagtacgtactctctgtccagcactttgaccctctcgaaggctgactacgagaaacataaggtgtatgcctgtgaggtaacacaccaggggctgtcttcccctgttactaagtcatttaatcgtggagaatgc
